United States Patent 11,446,398 (REGULATED BIOCIRCUIT SYSTEMS) - sequence listing, part 84

SEQ ID NO: 189146 - DNA, 3766 bp, Homo sapiens
  Payload ID: 17351
  Gene Symbol: TAPBP
  Gene Name: TAP binding protein (tapasin)
  Uniprot ID: O15533
  ENST ID: ENST00000383198
  CDS Start-End: 347-1693
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtatcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttctttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaacttttttttttttttttttgagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaa

SEQ ID NO: 189147 - DNA, 1824 bp, Homo sapiens
  Payload ID: 17351
  Gene Symbol: TAPBP
  Gene Name: TAP binding protein (tapasin)
  Uniprot ID: O15533
  ENST ID: ENST00000395114
  CDS Start-End: 172-1686
ctggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggctaaatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaa

SEQ ID NO: 189148 - DNA, 817 bp, Homo sapiens
  Payload ID: 17351
  Gene Symbol: TAPBP
  Gene Name: TAP binding protein (tapasin)
  ENST ID: ENST00000456592
  CDS Start-End: 347-817
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcatggggcacgctatgcctgtcgaattcaccatcccagcctgcctgcctcggggcgcagcgctgaggtcaccctggaggtag

SEQ ID NO: 189149 - DNA, 3684 bp, Homo sapiens
  Payload ID: 17351
  Gene Symbol: TAPBP
  Gene Name: TAP binding protein (tapasin)
  ENST ID: ENST00000412144
  CDS Start-End: 211-1611
ccaggagggcgcggtaaggctggggtatcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtagagatggggtttcaccatgttggccaggctgctctcgaactcctgacctcagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttctttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaacttttttttttttttttttgagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttccaaa

SEQ ID NO: 189150 - DNA, 612 bp, Homo sapiens
  Payload ID: 17351
  Gene Symbol: TAPBP
  Gene Name: TAP binding protein (tapasin)
  ENST ID: ENST00000451696
  CDS Start-End: 6-612
gcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtaca

SEQ ID NO: 189151 - DNA, 3759 bp, Homo sapiens; identical to SEQ ID NO: 189143
  Payload ID: 17351
  Gene Symbol: TAPBP
  Gene Name: TAP binding protein (tapasin)
  Uniprot ID: O15533
  ENST ID: ENST00000434618
  CDS Start-End: 347-1693

SEQ ID NO: 189152 - DNA, 612 bp, Homo sapiens
  Payload ID: 17351
  Gene Symbol: TAPBP
  Gene Name: TAP binding protein (tapasin)
  ENST ID: ENST00000444432
  CDS Start-End: 6-612
gcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtaca

SEQ ID NO: 189153 - DNA, 3766 bp, Homo sapiens; identical to SEQ ID NO: 189141
  Payload ID: 17351
  Gene Symbol: TAPBP
  Gene Name: TAP binding protein (tapasin)
  Uniprot ID: O15533
  ENST ID: ENST00000417059
  CDS Start-End: 347-1693

SEQ ID NO: 189154 - DNA, 3684 bp, Homo sapiens; identical to SEQ ID NO: 189140
  Payload ID: 17351
  Gene Symbol: TAPBP
  Gene Name: TAP binding protein (tapasin)
  ENST ID: ENST00000437315
  CDS Start-End: 211-1611

SEQ ID NO: 189155 - DNA, 1888 bp, Homo sapiens
  Payload ID: 17351
  Gene Symbol: TAPBP
  Gene Name: TAP binding protein (tapasin)
  ENST ID: ENST00000426633
  CDS Start-End: 172-1686
ctggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaattaacttaataatataccttatttaatctaataattctggtcccttatctgaaatgcttgggtc

SEQ ID NO: 189156 - DNA, 1824 bp, Homo sapiens; identical to SEQ ID NO: 189147
  Payload ID: 17351
  Gene Symbol: TAPBP
  Gene Name: TAP binding protein (tapasin)
  Uniprot ID: O15533
  ENST ID: ENST00000456807
  CDS Start-End: 172-1686

SEQ ID NO: 189157 - DNA, 612 bp, Homo sapiens; identical to SEQ ID NO: 189150
  Payload ID: 17351
  Gene Symbol: TAPBP
  Gene Name: TAP binding protein (tapasin)
  ENST ID: ENST00000432848
  CDS Start-End: 6-612

SEQ ID NO: 189158 - DNA, 612 bp, Homo sapiens; identical to SEQ ID NO: 189150
  Payload ID: 17351
  Gene Symbol: TAPBP
  Gene Name: TAP binding protein (tapasin)
  ENST ID: ENST00000456051
  CDS Start-End: 6-612

SEQ ID NO: 189159 - DNA, 751 bp, Homo sapiens
  Payload ID: 17351
  Gene Symbol: TAPBP
  Gene Name: TAP binding protein (tapasin)
  ENST ID: ENST00000467025
  CDS Start-End: 175-751
gaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttggaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccat

SEQ ID NO: 189160 - DNA, 1686 bp, Homo sapiens
  Payload ID: 17351
  Gene Symbol: TAPBP
  Gene Name: TAP binding protein (tapasin)
  ENST ID: ENST00000475304
  CDS Start-End: 211-1611
ccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtagagatggggtttcaccatgttggccaggctgctctcgaactcctgacctcagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataata

SEQ ID NO: 189161 - DNA, 1299 bp, Homo sapiens
  Payload ID: 17351
  Gene Symbol: TAPBP
  Gene Name: TAP binding protein (tapasin)
  ENST ID: ENST00000489157
  CDS Start-End: 214-1299
agtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtga

SEQ ID NO: 189162 - DNA, 2884 bp, Homo sapiens
  Payload ID: 17351
  Gene Symbol: TAPBP
  Gene Name: TAP binding protein (tapasin)
  ENST ID: ENST00000548408
  CDS Start-End: 204-674
ggcgcggtaaggctggggtatcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttctttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaacttttttttttttttttttgagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggaccggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttcc

SEQ ID NO: 189163 - DNA, 3495 bp, Homo sapiens
  Payload ID: 17351
  Gene Symbol: TAPBP
  Gene Name: TAP binding protein (tapasin)
  ENST ID: ENST00000551943
  CDS Start-End: 347-1432
ggggacgcggcacagatagggggaagccggagtaatggttttcgggcaagtggatgttggagagcacacacaggagttggggggcgggggagggcctggggttggggagggctcgaactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctacagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtggttctcaaaatttttttctctcaggacctcttaaaaatcatcaaggaccccaaaaagcttttgggtatgtgggttatagctatcaatatttatggtactagaacttaaaagtgagaaaaatttaaaacacgagaatacataggcacacattctattcatcgtgggaaccatggtgtcaatacatatcatgtagcttctgaaaaactccactgtacacttatagaatgaagaaggcaaaaaacttttttttttttttttttgagacggagtctcgctctgtcgcccaggctggagtgcagtggcgcgatctcggctcactgcaagctccgcctctcgggttcacgccattctcctgcctcagcctcccaagtagctcggactacaggcgtcctccaccatgcctggctaatattttgtattttttagtagagacggggtttcaccgtgttagccaggatggtctcgatctcctaacctggtgatccgcccgcctcggcctcccaaagtattgggattacccgcgtgagccaccgcgcccggctgcaaataatctttctttttttctgagacagagtctcgctctgttgcccaggctggagtgcagtggcacgatctcggctcacggcacgctccgcctcccgggttcacgccattctcctgcctcagcttcccgagtagctgggactacaggggcccgccaccacgcccggctaactttttgtgtttttagtagagacggggtttcaccgtgttagccaggatggtctcgatctcctgaccttgtgatctgcccgcctcggcctcccaaagtgctgggattacaggcgtgagccaccgcgcccggcggcgaaacacgatattgtactaacatcttaattttgttataaaatctcacaaaccccctgacatagtctcagagatctgtagggccgaggttacatttggagaacccgtactctagggccaaatccattcttcttgccctggctcacttgtcccccccaccgccccgcgctggagccactgcctagttcttcagccctagatggtgctcgccagacctcctctcaatgctcatcacacacagggctattcctttcctccaatgaaccaaacgcctcccgcccacctccaggtcccagtcctctgttccctttgcctggtccacccttgccctccctgggtcgcagacgaggtcggcctcgtcattccccgcagaccgccgcgcgtccctcttgtgcggttcaccacagttgtatttaagtgatcgtgtgagtcgtcgttaaatgcctgtctccccgcggatcatgggctcctcgaggacagggactggcctgtctgtccactgctgtaaccccgcgccggcatagggacctaaggcccactggagggcgctcatcaagtagctgctggatgttgacgaaggaagcggcggcgcagctcagggatctccgagtcaggacggtcggccagacccacggggtaacgggtctaatcgtgtaggaataaagctgtattccagtgcttcc

SEQ ID NO: 189164 - DNA, 1476 bp, Homo sapiens
  Payload ID: 17351
  Gene Symbol: TAPBP
  Gene Name: TAP binding protein (tapasin)
  ENST ID: ENST00000553235
  CDS Start-End: 130-1476
acaccggtcccccaggcaccttcacctaaccagagcggggatttccaccgcccctcatgccgccctttggaggaaagtgaaagtgaaaggaggaagaggaggctaaatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagcatgctacttaa

SEQ ID NO: 189165 - DNA, 817 bp, Homo sapiens; identical to SEQ ID NO: 189148
  Payload ID: 17351
  Gene Symbol: TAPBP
  Gene Name: TAP binding protein (tapasin)
  ENST ID: ENST00000550794
  CDS Start-End: 347-817

SEQ ID NO: 189166 - DNA, 1476 bp, Homo sapiens
  Payload ID: 17351
  Gene Symbol: TAPBP
  Gene Name: TAP binding protein (tapasin)
  ENST ID: ENST00000549142
  CDS Start-End: 130-1476
acaccggtcccccaggcaccttcacctaaccagagcggggatttccaccgcccctcatgccgccctttggaggaaagtgaaagtgaaaggaggaagaggaggcttcatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctgccttcaggcggtatccccggggcgcccccgcaccacactgcgagatgagccgcttcgtgcctctccccgcctctgcgaaatgggccagcggcctgacccccgcgcagaactgcccgcgggccctggatggggcttggctgatggtcagcatatccagcccagtcctcagcctctccagcctcttgcgaccacagccagagcctcagcaggagcctgttctcatcaccatggcaacagtggtactgactgtcctcacccacacccctgcccctcgagtgagactgggacaagatgctctgctggacttgagctttgcctacatgccccccacctccgaggccgcctcatctctggctccgggtccccctccctttgggctagagtggcgacgccagcacctgggtaagggacatctgctcctggctgcaactcctgggctgaatggccagatgccagcagcccaagaaggggccgtggcatttgctgcttgggatgatgatgagccatggggcccatggaccggaaatgggaccttctggctgcctagagttcaaccctttcaggagggcacctatctggccaccatacacctgccatacctgcaaggacaggtcaccctggagcttgctgtgtacaaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtctttcagggccctcccttgaggacagcgtaggccttttcctgtctgcctttcttctgcttgggctcttcaaggcactgggctgggctgctgtctacctgtccacctgcaaggattcaaagaagcatgctacttaa

SEQ ID NO: 189167 - DNA, 1476 bp, Homo sapiens; identical to SEQ ID NO: 189164
  Payload ID: 17351
  Gene Symbol: TAPBP
  Gene Name: TAP binding protein (tapasin)
  ENST ID: ENST00000550330
  CDS Start-End: 130-1476

SEQ ID NO: 189168 - DNA, 1741 bp, Homo sapiens
  Payload ID: 17352
  Gene Symbol: TAPBPL
  Gene Name: TAP binding protein-like
  Uniprot ID: Q9BX59
  ENST ID: ENST00000266556
  CDS Start-End: 166-1572
gtgaaagtgaaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccaagccccacccagcagaggggcagtggcgggcagtggacgtggtcctagactgcttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcagtggacctggtccagattccccaggccgaggccttgctccatgctgactgcagtgggaaggaggtgacctgtgagatctcccgctactttctccagatgacagagaccactgttaagacagcagcttggttcatggccaacatgcaggtctctggagggggacctagcatctccttggtgatgaagactcccagggtcaccaagaatgaggcgctctggcacccgacgctgaacttgccactgagcccccaggggactgtgcgaactgcagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcagggcaggggcaggctgtgcggaagggcgctaccctggagcctgcacaactgggcatggccagggatgcctccctcaccctgcccggcctcactatacaggacgaggggacctacatttgccagatcaccacctctctgtaccgagctcagcagatcatccagctcaacatccaagcttcccctaaagtacgactgagcttggcaaacgaagctctgctgcccaccctcatctgcgacattgctggctattaccctctggatgtggtggtgacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccagagcggagaacagccttgggagtcatctttgccagcagtctcttccttcttgcactgatgttcctggggcttcagagacggcaagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacatgcctttggtggaagt

SEQ ID NO: 189169 - DNA, 772 bp, Homo sapiens
  Payload ID: 17352
  Gene Symbol: TAPBPL
  Gene Name: TAP binding protein-like
  ENST ID: ENST00000544021
  CDS Start-End: 178-735
atcttgctctaagtgaaagtgaaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccatggacctggtccagattccccaggccgaggccttgctccatgctgactgcagtgggaaggaggtgacctgtgagatctcccgctactttctccagatgacagagaccactgttaagacagcagcttggttcatggccaacatgcaggtctctggagggggacctagcatctccttggtgatgaagactcccagggtcaccaagaatgaggcgctctggcacccgacgctgaacttgccactgagcccccaggggactgtgcgaactgcagtggagttccaggtgatgacacagacccaatccctgagcttcctgctggggtcctcagcctccttggactgtggcttctccatggcaccgggcttggacctcatcagtgtggagtggcgactgcagcacaagggcaggggacgaggggacctacatttgccagatcaccacctctctgtaccgagctcagcagatcatccagctcaacatccaagcttcccctaaagtacgactgagcttggcaaacgaagctctgctgccc

SEQ ID NO: 189170 - DNA, 2109 bp, Homo sapiens
  Payload ID: 17353
  Gene Symbol: TPRN
  Gene Name: taperin
  ENST ID: ENST00000333046
  CDS Start-End: 1-1614
aactccttcaccgtccacccccggggtctgcaccgcggcgcgggcgcccgcctgctctccaacgggcactcggcccctgagccccgggccggccctgccaaccgcctcgcgggctccccgcctgggtcgggacagtggaagccaaaggtggagtcgggggatccctccctccacccgccccccagccccgggaccccgagtgccactccagcctcaccccctgccagtgccactcctagccagcgccagtgcgtctccgcagccaccagcaccaacgactccttcgagatacggccggcccccaagccagttatggagaccatccccttgggggacctccaggcccgggcgctggccagcctccgcgcaaactctcgaaattctttcatggtcatccccaagagcaaggcctccggggctcctcctcctgaggggaggcagtccgtggagctgccaaagggagacctgggcccggcctccccgagccaggagctcggatcccagccggtgcctggaggggatggtgcgcctgccctcgggaagagccccctggaggtcgaggcacagtgggcagtcgaggagggggcctgtcccaggacagccaccgccctcgctgaccgggctattaggtggcagaggccgtcctcaccgccccccttcctgccggctgcttcggaagaagctgagcctgctgagggcctcagggttcctggcttggccaagaatagccgggaatatgtgaggccggggctgcctgtcaccttcatcgatgaggtagactcggaggaggccccccaagcagccaaactaccctacctcccgcaccctgccaggcctctgcaccctgccaggcccgggtgcgtggcagagcttcagccccggggcagcaacaccttcacagtggtgcccaagaggaagccagggactctgcaggaccagcacttcagtcaggccaacagggagcctcggccacgggaggccgaggaggaggaggctagttgcctcctggggcccacgttgaagaagcgctaccccaccgtgcatgagatcgaggtgattggcggctacctggccctgcagaagtcctgcctcaccaaggctggctcctcaagaaagaagatgaagatctccttcaacgacaaaagcctgcagaccacatttgagtacccttccgagagctccctagagcaggaggaagaggtggaccagcaggaggaggaggaggaggaggaggaggaagaggaagaggaggaagagggatccggctcagaggagaagccctttgcactcttcctgccccgggccacgtttgtgagcagcgtgagacccgagagctctcggctgccagagggtagctcaggcctgtccagctacaccccgaagcactctgtggccttcagcaagtggcaggagcaggcgctggagcaggccccgagggaggcagagcccccgcccgtggaggccatggtgagatgcgggggagtggagcgctggggggagtctgacacccgggcgagcccatgtgtccacattctgtcctctcactttcagctcacacccgccagtcagaatgacctctcggacttccgcagcgagccagccctgtatttctgagcccagcactgccaggaccaaggctgagcccagctgtgggagtcccggaagctgggcagtagccagggactactgcacccgcttctgccttgtttggcctcactgtatcccacccacccctcctggccctggaagcagctagggtgcctcctgccatcggggccaggtctgggtctcactccccggccctgatttgggagggtccaagggggaagtggggtggggaactgcctgtgggtgagtgccaggggcctgctgggtggtggccatctgcgacccggcagggggctgtgcagattctgcacctggccattccctgtcctgtctcctcagcctgcctcacagtggccatggggtgtcggggtgaagggctgtcccagctacttgtcctctgcaggaccctaagcccctgcccgcagcccacatgccctctgtgatgagtggcgtctttcctgcctctgatgatggactcaataaacagcactggacaaggct

SEQ ID NO: 189171 - DNA, 2718 bp, Homo sapiens
  Payload ID: 17353
  Gene Symbol: TPRN
  Gene Name: taperin
  Uniprot ID: Q4KMQ1
  ENST ID: ENST00000409012
  CDS Start-End: 88-2223
gggggcgtggccgcggcgcccaggctggccgcggcggcggctgccactccggccctcagtccagccgtccgctgccgcgttcgcagcatggccgccctggggcggccgggctcggggccgcgcgctgcggtgcccgcttggaagcgtgagatcctggagcggaagcgggccaagctagccgcgctgggcgggggcgcggggcccggggcggcggagcccgagcagcgggtgctggccgagagcctgggcccgctgcgcgagaacccgttcatgctgctggaggccgagcggcggcgcggcgggggcgcggcgggggcgcggctgctggagcggtaccgccgcgtgcctggcgtgcgcgccctccgcgccgacagcgtcctcatcatcgagacggtgcccggcttcccgcccgcgccgcccgccccgggggccgcgcagatccgcgccgccgaggtgctggtgtacggggcgccgcccggccgcgtcagccgcctactggagaggttcgacccgcccgccgcgccgcgccgccgcgggagccccgagcgcgcccgccccccgccgccgccgccgccgcccgcgccgccccggcccccgcccgcggcccccagcccgcccgccgcgcccgggccccgcggtggcggggcgagccccggggcccggcgcagcgacttcctccagaagaccggcagcaactccttcaccgtccacccccggggtctgcaccgcggcgcgggcgcccgcctgctctccaacgggcactcggcccctgagccccgggccggccctgccaaccgcctcgcgggctccccgcctgggtcgggacagtggaagccaaaggtggagtcgggggatccctccctccacccgccccccagccccgggaccccgagtgccactccagcctcaccccctgccagtgccactcctagccagcgccagtgcgtctccgcagccaccagcaccaacgactccttcgagatacggccggcccccaagccagttatggagaccatccccttgggggacctccaggcccgggcgctggccagcctccgcgcaaactctcgaaattctttcatggtcatccccaagagcaaggcctccggggctcctcctcctgaggggaggcagtccgtggagctgccaaagggagacctgggcccggcctccccgagccaggagctcggatcccagccggtgcctggaggggatggtgcgcctgccctcgggaagagccccctggaggtcgaggcacagtgggcagtcgaggagggggcctgtcccaggacagccaccgccctcgctgaccgggctattaggtggcagaggccgtcctcaccgccccccttcctgccggctgcttcggaagaagctgagcctgctgagggcctcagggttcctggcttggccaagaatagccgggaatatgtgaggccggggctgcctgtcaccttcatcgatgaggtagactcggaggaggccccccaagcagccaaactaccctacctcccgcaccctgccaggcctctgcaccctgccaggcccgggtgcgtggcagagcttcagccccggggcagcaacaccttcacagtggtgcccaagaggaagccagggactctgcaggaccagcacttcagtcaggccaacagggagcctcggccacgggaggccgaggaggaggaggctagttgcctcctggggcccacgttgaagaagcgctaccccaccgtgcatgagatcgaggtgattggcggctacctggccctgcagaagtcctgcctcaccaaggctggctcctcaagaaagaagatgaagatctccttcaacgacaaaagcctgcagaccacatttgagtacccttccgagagctccctagagcaggaggaagaggtggaccagcaggaggaggaggaggaggaggaggaggaagaggaagaggaggaagagggatccggctcagaggagaagccctttgcactcttcctgccccgggccacgtttgtgagcagcgtgagacccgagagctctcggctgccagagggtagctcaggcctgtccagctacaccccgaagcactctgtggccttcagcaagtggcaggagcaggcgctggagcaggccccgagggaggcagagcccccgcccgtggaggccatgctcacacccgccagtcagaatgacctctcggacttccgcagcgagccagccctgtatttctgagcccagcactgccaggaccaaggctgagcccagctgtgggagtcccggaagctgggcagtagccagggactactgcacccgcttctgccttgtttggcctcactgtatcccacccacccctcctggccctggaagcagctagggtgcctcctgccatcggggccaggtctgggtctcactccccggccctgatttgggagggtccaagggggaagtggggtggggaactgcctgtgggtgagtgccaggggcctgctgggtggtggccatctgcgacccggcagggggctgtgcagattctgcacctggccattccctgtcctgtctcctcagcctgcctcacagtggccatggggtgtcggggtgaagggctgtcccagctacttgtcctctgcaggaccctaagcccctgcccgcagcccacatgccctctgtgatgagtggcgtctttcctgcctctgatgatggactcaataaacagcactggacaaggct

SEQ ID NO: 189172 - DNA, 5130 bp, Homo sapiens
  Payload ID: 17354
  Gene Symbol: TARBP1
  Gene Name: TAR (HIV-1) RNA binding protein 1
  Uniprot ID: Q13395
  ENST ID: ENST00000040877
  CDS Start-End: 1-4866
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggaccccagtctgcagcctcgccaccgccggcgcgtgctgagggcggcgggcgcggccctgcgctcgtgcgtccgcctggccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgcgtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggcccaagtctgttttggtggtctgagaggaaaaaagatgagcttctaaagttttgggaaaattatattttaattatggagactttagaaggaaatcagatacatgttataaagccagttttaccaaagctaaacaatctgtttgaatatgcggtgtcagaggaaaatggatgttggctctttcacccatcctggcatatgtgtatttataaaagaatgtttgaaagtgaaaacaaaatcctgtccaaagaaggtgttatccattttttggagctgtatgaaacaaagattcttccattttcaccagaattttctgagtttattattggaccattaatggatgcgctttcagagagctctctgtatagcaggtccccaggccagccaataggaagctgttctccattgggactgaaattacagaagtttttagtcacttatatttctcttcttccagaagaaataaagagtagcttcctattgaagtttattcggaagatgacaagtaggcattggtgtgctgttcccattttgtttctatctaaggctttggcaaatgtcccaagacataaggccctgggtatagatgggcttcttgctctcagggatgttattcattgcactatgatcacacatcagattctcctgagaggggcagcccaatgctaccttcttcaaacagctatgaatttgctagatgtggagaaagtgtcactttctgatgtctcaacttttctcatgtctctgagacaagaggaatccttaggacgaggaacttcattgtggacagagctgtgtgactggctacgtgttaatgaaagctattttaagccatcccctacgtgtagctccattggacttcacaagacatctttaaatgcttatgtaaagagcattgttcaagagtatgttaagtcatctgcttgggaaacaggagaaaactgctttatgcctgattggtttgaagccaagcttgtttctctgatggtcttgctggctgtggatgtggaaggaatgaagactcagtatagcggaaagcagagaacagagaatgtattgcggatattcttagaccctcttctggatgtgcttatgaagtttagtaccaatgcctacatgcccttgctgaagactgacagatgcctccagctgctgttgaagctgttgaacacatgcaggttgaaaggttccagtgcccaagatgatgaggtgtctactgttcttcagaactttttcatgtctactacagagagcatttctgaatttattctcagaagacttactatgaatgagctaaatagtgtttcagatctggatcgttgccatttatacctgatggtgttaactgagcttataaatctgcatttgaaggttgggtggaaaaggggtaaccctatctggagagttatttctcttttgaaaaatgcatccattcagcatcttcaagagatggacagtggacaggagccaacagttggaagtcagattcagagagtagtgagcatggctgccttggccatggtgtgtgaggccatagaccagaagcctgagctgcagctggactctctccatgctgggcccctggaaagcttcctttcctctcttcagctcaatcagacgctgcagaagccccacgcagaggagcagagcagttatgctcaccccttggagtgcagcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagagattatgtacaagataattgaaatgtctgctataaagactggagtcttcaatacactgataagttactgctgtcagtcttggatagtgtctgcttcaaatgtgtcccaaggatctttatcaagtgctaaaaattatagcgaacttatccttgaggcttgtatatttggaactgtgtttaggcgtgatcaaagacttgttcaggatgtacagaccttcatagaaaaccttggacatgactgtgcggcaaatattgttatggaaaatactaagagagaagaccattatgtgagaatttgtgctgtcaaattcctgtgtttattagatggctccaatatgtcccacaagttgtttattgaggatcttgcaatcaagctattagataaagatgaattagtgtccaagtccaaaaaacgctactatgtgaattctctacagcacagagtgaaaaaccgagtgtggcagactctgctggtacttttccctagacttgaccagaatttcttgaatggaattattgacaggattttccaggctggtttcaccaacaatcaagcatccataaaatattttatagaatggattattatattgattcttcataaattccctcaatttcttccaaagttctgggattgtttttcttatggtgaagaaaatcttaaaacaagcatttgtacgtttttagcagttttatcacatttagacattattactcaaaatattccagaaaagaaactaattctgaagcaagcccttatagttgtgctgcagtggtgtttcaatcacaattttagtgttcgactgtatgctttagttgctcttaagaaactctggactgtgtgtaaagtgttaagtgttgaagaatttgatgccctgactcctgtgattgaatccagcctccatcaagtggaaagcatgcacggagcagggaatgccaagaagaattggcaacgcattcaggagcatttcttttttgcaacatttcacccactcaaggattattgtctagagaccatattttacatccttccacgcctttcaggccttattgaagatgaatggatcaccattgataaatttaccagattcactgatgttcctttagctgcgggatttcagtggtacctttctcaaactcaacttagtaaactaaaaccaggtgactggtctcagcaagacataggtactaatttggtcgaagcagataaccaagcggagtggaccgacgttcagaagaagattatcccgtggaacagtcgtgtttccgacttagacctggagctcctgtttcaggatcgtgctgccagacttggaaagtcaattagtagactcatcgttgtggcctcgctcatcgacaaaccgaccaatttaggaggactgtgcaggacctgtgaggtatttggggcttcagtgctcgttgttggcagccttcagtgtatcagcgacaaacagtttcagcacctcagtgtctctgcagaacagtggcttcctctagtggaggtaaaaccacctcagctaattgattatctgcagcagaagaaaacagaaggttataccatcattggagtggaacaaactgccaaaagtttagacctaacccaatattgctttcctgagaaatctctgctcttgttgggaaatgaacgtgagggaattccagcaaatctgatccaacagttggacgtttgtgtggaaattcctcaacagggcattatccgctccctgaatgtccatgtgagtggagccctgctgatctgggagtacaccaggcagcagctgctctcgcacggagataccaagccatgatgtgccttccttagtgaactgctgctgctgttcagacttttttaaaaaaaactatttggactaaagaaacagattctgaaatttattgtgataatttgtatttcttttttcttgcaatttaatgccaaaagtttgccatgtgccttaaacatattactatatattttcccctttaataaacactttttgttaaattgtattcttcctttaataaaatattttaagcaattgtggaaataaaacaatggattttttaagagagaa

SEQ ID NO: 189173 - DNA, 1867 bp, Homo sapiens
  Payload ID: 17355
  Gene Symbol: TARBP2
  Gene Name: TAR (HIV-1) RNA binding protein 2
  Uniprot ID: Q15633
  ENST ID: ENST00000266987
  CDS Start-End: 484-1584
tccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttttaa

SEQ ID NO: 189174 - DNA, 1402 bp, Homo sapiens
  Payload ID: 17355
  Gene Symbol: TARBP2
  Gene Name: TAR (HIV-1) RNA binding protein 2
  Uniprot ID: Q15633
  ENST ID: ENST00000394357
  CDS Start-End: 101-1138
ctgcctccagctctaaatagtttggggttggcccggttcccagactgcactggaacactgggctttatgcccccacattcagtgcatttgtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatg

SEQ ID NO: 189175 - DNA, 1368 bp, Homo sapiens
  Payload ID: 17355
  Gene Symbol: TARBP2
  Gene Name: TAR (HIV-1) RNA binding protein 2
  Uniprot ID: Q15633
  ENST ID: ENST00000456234
  CDS Start-End: 55-1092
gctcttgggttctgtagttttctcgcgatccaaaaggctccgtgcccaaagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtgga

SEQ ID NO: 189176 - DNA, 992 bp, Homo sapiens
  Payload ID: 17355
  Gene Symbol: TARBP2
  Gene Name: TAR (HIV-1) RNA binding protein 2
  ENST ID: ENST00000551741
  CDS Start-End: 129-407
ttcccggcgtgcaccggggcagtggctgctgcctccagctctaaatagtttggggttggcccggttcccagactgcactggaacactgggctttatgcccccacattcagtgcatttgtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgg

SEQ ID NO: 189177 - DNA, 1132 bp, Homo sapiens
  Payload ID: 17355
  Gene Symbol: TARBP2
  Gene Name: TAR (HIV-1) RNA binding protein 2
  ENST ID: ENST00000550407
  CDS Start-End: 1-682
cccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactaga

SEQ ID NO: 189178 - DNA, 1493 bp, Homo sapiens
  Payload ID: 17355
  Gene Symbol: TARBP2
  Gene Name: TAR (HIV-1) RNA binding protein 2
  ENST ID: ENST00000548971
  CDS Start-End: 104-388
ccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcaggtgagggaggaaccgaggcatcccagaagcccttcaaggaacccaggccctgcaccacccactctgccccgaggcctggccagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcc

SEQ ID NO: 189179 - DNA, 759 bp, Homo sapiens
  Payload ID: 17355
  Gene Symbol: TARBP2
  Gene Name: TAR (HIV-1) RNA binding protein 2
  ENST ID: ENST00000547064
  CDS Start-End: 171-759
ggaggctgcagtcacggtggcgcccgcggggacggaggagggaatgagtgaagaggagcaaggctccggcactaccacgggctgcgggctgcctaggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgcc

SEQ ID NO: 189180 - DNA, 1466 bp, Homo sapiens
  Payload ID: 17355
  Gene Symbol: TARBP2
  Gene Name: TAR (HIV-1) RNA binding protein 2
  ENST ID: ENST00000549679
  CDS Start-End: 115-381
cggggcagtggctgctgcctccagctctaaatagtttggggttggcccggttcccagactgcactggaacactgggctttatgcccccacattcagtgcatttgtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcaggtgagggaggaaccgaggcatcccagaagcccttcaaggaacccaggccctgcaccacccactctgccccgaggcctggccagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactaga

SEQ ID NO: 189181 - DNA, 1514 bp, Homo sapiens
  Payload ID: 17355
  Gene Symbol: TARBP2
  Gene Name: TAR (HIV-1) RNA binding protein 2
  ENST ID: ENST00000549572
  CDS Start-End: 116-679
ccggggcagtggctgctgcctccagctctaaatagtttggggttggcccggttcccagactgcactggaacactgggctttatgcccccacattcagtgcatttgtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcagagtctgaggctcctgcgtggggaccagcgtgggtgtgagaagccttttttcactcagcctcatgcaccctgtgtctcccttccaaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtgg

SEQ ID NO: 189182 - DNA, 916 bp, Homo sapiens
  Payload ID: 17355
  Gene Symbol: TARBP2
  Gene Name: TAR (HIV-1) RNA binding protein 2
  ENST ID: ENST00000552857
  CDS Start-End: 136-633
ccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctgg

SEQ ID NO: 189183 - DNA, 1855 bp, Homo sapiens
  Payload ID: 17355
  Gene Symbol: TARBP2
  Gene Name: TAR (HIV-1) RNA binding protein 2
  ENST ID: ENST00000550147
  CDS Start-End: 489-830
gcctctccagctgcgacacagatggcgcgcgggctcttgggttctgtagttttctcgcgatccaaaaggctccgtgcccaagtgagtccttaccgcctccctacccagcggcttcccctccgctagtacgcatgtccacagcttcacggaccgggagagagggggcgcggaaggaaggaggcgggacggtattacaaacaaaaaaatacggccttctcgagaagcgacggcggagggcccgctcctcccagaaggcggtgcagcctgcccgggcgagccacgcacgcagagggttgtggggcggatagctcccctccagatggaggctcacgaagtagggtgggcgggggactccatatcccagcgtgccccgcggcgggccctaccggccgcgactccgggcttggccccggccctagctcgtcggctgtgtattggggcgcgtggaggctgcagtcacggtggcgcccgcggggacggaggagggaatgagtgaagaggagcaaggctccggcactaccacgggctgcgggctgcctagtatagagcaaatgctggccgccaacccaggcaagaccccgatcagccttctgcaggagtatgggaccagaatagggaagacgcctgtgtacgaccttctcaaagccgagggccaagcccaccagcctaatttcaccttccgggtcaccgttggcgacaccagctgcactggtcagggccccagcaagaaggcagccaagcacaaggcagctgaggtggccctcaaacacctcaaaggggggagcatgctggagccggccctggaggacagcagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccggggcccaggttgcacctgggattctctacgaaattcagtaggagagaagatcctgtccctccgcagttgctccctgggctccctgggtgccctgggccctgcctgctgccgtgtcctcagtgagctctctgaggagcaggcctttcacgtcagctacctggatattgaggagctgagcctgagtggactctgccagtgcctggtggaactgtccacccagccggccactgtgtgtcatggctctgcaaccaccagggaggcagcccgtggtgaggctgcccgccgtgccctgcagtacctcaagatcatggcaggcagcaagtgaagccccagctggactcatggatgtgcaccctttgctccctgctctttctgcctctgggctcatgtatctgcgcagctctggtaccctctgtgggtgccatctctacctctgacacagactgcctgccttgaagctgagaaggcacagggcaaggagccaaggaccacagagcctcagccagcccaggatccgtcctcattttattggtgatgatgaatgggaatgaaatcagggggctgtctactagagcctggaataaatatgctgctttgtggatttttaa

SEQ ID NO: 189184 - DNA, 668 bp, Homo sapiens
  Payload ID: 17355
  Gene Symbol: TARBP2
  Gene Name: TAR (HIV-1) RNA binding protein 2
  ENST ID: ENST00000552817
  CDS Start-End: 187-668
gcgtgcaccggggcagtggctgctgcctccagctctaaatagtttggggttggcccggttcccagactgcactggaacactgggctttatgcccccacattcagtgcatttggtcagggccccagcaagaaggcagccaagcacaaggcagctgaggtggccctcaaacacctcaaaggggggagcatgctggagccggccctggaggacagcagttctttttctcccctagactcttcactgcctgaggacattccggtttttactgctgcagcagctgctaccccagttccatctgtagtcctaaccaggagcccccccatggaactgcagccccctgtctcccctcagcagtctgagtgcaaccccgttggtgctctgcaggagctggtggtgcagaaaggctggcggttgccggagtacacagtgacccaggagtctgggccagcccaccgcaaagaattcaccatgacctgtcgagtggagcgtttcattgagattgggagtggcacttccaaaaaattggcaaagcggaatgcggcggccaaaatgctgcttcgagtgcacacggtgcctctggatgcccgggatggcaatgaggtggagcctgatgatgaccacttctccattggtgtgggctcccgcctggatggtcttcgaaaccgggg

SEQ ID NO: 189185 - DNA, 5367 bp, Homo sapiens
  Payload ID: 17356
  Gene Symbol: TARDBP
  Gene Name: TAR DNA binding protein
  Uniprot ID: Q13148
  ENST ID: ENST00000240185
  CDS Start-End: 357-1601
aaaccatctgctacgttacgtggggggaggtcagctcctatacagccacacttttttcaatcttcagcttttcaggcctaggtcctggttttattttagctttcagagcttctctgtaggcttgaatttccaggaggcagcccgagtccctggggagagggtcatcgtggctctcgtcggtgccttccacctctggacaggcaaccggtgggagaggacgccggtgggcggggggaggaggcggccctagcgccattttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtgaaaatttttttttttcttttgaaatctagttttgaataagtctgggtgaccgcacctaaaatggtaagcagtaccctccggctttttcttagtgcctctgtgcatttgggtgatgttctatttacatggcctgtgtaaatctccattgggaagtcatgccttctaaaaagattcttatttgggggagtgggcaaaatgttgattattttctaatgctttgtagcaaagcatatcaattgaaaagggaatatcagcaccttcctagtttgggatttgaaaagtggaattaattgcagtagggataaagtagaagaaaccacaaattatcttgtgcctgaaatccattaagaggcctgatagctttaagaattagggtgggttgtctgtctggaagtgttaagtggaatgggctttgtcctccaggaggtgggggaatgtggtaacattgaatacagttgaataaaatcgcttacaaaactcacactctcacaatgcattgttaagtatgtaaaagcaataacattgattctctgttgtacttttttgtaactaattctgtgagagttgagctcattttctagttggaagaatgtgatatttgttgtgttggtagtttacctaatgcccttacctaattagattatgataaataggtttgtcattttgcaagttacataaacatttatcaatgaagtcatcctttagacttgtaatcgccacattgtttcattattcagtttcctctgtaaagggatcttgagttgttttaattttttttttctgcatctgaatctgcatgatttccaaaccctgtaccatctgaattttgcattttagcacttgcactattactcagcagcagtaacatggtaacacttaaaatggtactcggggacctccaaagactaaactgacaagccttcaaggagcccaggggtaagttaacttgtcaacggcatggtttaatcccttctttacacttgtgtaaatttcagttactggtcatagaaggctttcaatgttgagtggccttttattaacatgtttatggtactgcatagatacgggtatttattttaccctaagaagattttgaagtttaaaagtacttaaactatttggcaaagatttgtttttaaaaatctatttggtcaatctaaatgcattcattctaaaaaattttttgaaccagataaataaaatttttttttgacaccacagtttagtgtctggagtcttactggaaaaacacgatttctttttatatgtgatatacagatgctggaaagttacctttaaaaattgagtctctaaagaaaaaagaaaataataaaaattgagtctcaagaagttgtacttcatatgcacaagagaaatgaggccaagactcacagtaagcttttacatggaatggtaacttttagttagactgaaaaacttgaatgttagctattaaaaccttttaggaaggaatagccagctaaaaccaaatgagatttttaaagttaaatcagcacttaagttgtgtccttagtaggaaaaagtaggaagttaactactccgtaatccaagagataatgtgtaacagtaagaatgattttgttgttgttgagtatgagcaaagtagcccctaagtgtgtattagggttctgtacttaactgttgtgtgatgtgtgcttttgttaggcatcactgtgcccaagtatttcatgttcattgtaaagaggaaaaatacagatttctctataatgtcaccacttatttctaatgccacttttcatcttgtggaaatgccatgttttgattcagtcttctgaatttgaacattattcaggttatttccaattgctgggaatatccttactgctaaaataaattcttagcattggaattgctaggtcaaagattatgcatgctttttaagggcttttgaaatgtattgccagtctgtggcctgccaccctccctgaacatgcctggtcttgcttaaaatgtattgccaaatagtccttgggaagtttatgttgtctttaacaatgtgaaatagtactactattcacgttccttttgtctgacaatttgataagtgaataattgtatcccaccattctgtagtattggtttttaacatggaaattttagtcaata

SEQ ID NO: 189186 - DNA, 1835 bp, Homo sapiens
  Payload ID: 17356
  Gene Symbol: TARDBP
  Gene Name: TAR DNA binding protein
  ENST ID: ENST00000315091
  CDS Start-End: 13-900
gaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtgttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataatatgtgtctttgttttgcagccctgaatgcaaagaattcatagcagttaattccccttttttgacccttttgagatggaactttcataaagtttcttggcagtagtttattttgcttcaaataaacttatttgaaaagtt

SEQ ID NO: 189187 - DNA, 1388 bp, Homo sapiens
  Payload ID: 17356
  Gene Symbol: TARDBP
  Gene Name: TAR DNA binding protein
  ENST ID: ENST00000439080
  CDS Start-End: 104-358
cattttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaag

SEQ ID NO: 189188 - DNA, 1946 bp, Homo sapiens
  Payload ID: 17356
  Gene Symbol: TARDBP
  Gene Name: TAR DNA binding protein
  ENST ID: ENST00000473869
  CDS Start-End: 13-909
gaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccagttcatctcatttcaaatgtttatggaagaagcacttcattgaaagtagtgctgtaaatattctgccataggaatactgtctacatgctttctcattcaagaattcgtcatcacgcatcacaggccgcgtctttgacgccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtgaaaatttttttttttcttttgaaatctagttttgaataagtctgggtgaccgcacctaaaatggtaagcagtaccctccggctttttcttagtgcctctgtgcatttgggtgatgttctatttacatggcctgtgtaaatctccattgggaagtcatgccttctaaaaagattcttatttgggggagtgggcaaaatgttgattattttctaatgctttgtagcaaagcatatcaattgaaaagggaatatcagcaccttcctagtttgggatttgaaaagtggaattaattgcagtagggataaagtagaagaaaccacaaattatcttgtgcctgaaatccattaagaggcctgatagctttaagaattagggtgggttgtctgtctggaagtgttaagtggaatgggctttgtcctccaggaggtgggggaatgtggtaacattgaatacagttgaataaaatcgcttacaaaactcacactctcacaatgcattgttaagtatgtaaaagcaataacattgattctctgttgtacttttttgtaactaattctgtgagagttgagctcattttctagttggaagaatgtgatatttgttgtgttggtagtttacctaatgcccttacctaattagattatgataaataggtttgtcattttgcaagttacataaacatttatcaatgaagtcatcctttagacttgtaatcgccacattgtttcattattcagtttcctctgt

SEQ ID NO: 189189 - DNA, 1001 bp, Homo sapiens
  Payload ID: 17356
  Gene Symbol: TARDBP
  Gene Name: TAR DNA binding protein
  ENST ID: ENST00000472476
  CDS Start-End: 103-345
attttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagtatagacggcgtttcaccatcttggccaggctggtcttgaactcctgaccttgtgatccacctgcctcagactcccaaagtgctgggattacaagtgtgagccaccgcgcccagccagttatgtttttttaaataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttca

SEQ ID NO: 189190 - DNA, 701 bp, Homo sapiens
  Payload ID: 17356
  Gene Symbol: TARDBP
  Gene Name: TAR DNA binding protein
  ENST ID: ENST00000473118
  CDS Start-End: 98-701
gcgctttgaaagtgcgcgagctccgaccgagacctgggccggcggttggtcggccgaaaccatctgctacgttacgtggggggaggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggaca

SEQ ID NO: 189191 - DNA, 409 bp, Homo sapiens
  Payload ID: 17356
  Gene Symbol: TARDBP
  Gene Name: TAR DNA binding protein
  ENST ID: ENST00000477447
  CDS Start-End: 1-196
tgcagatgatcagattgcgcagtctctttgtggagaggacttgatcattaaaggaatcagcgttcatatatccaatgccgaacctaagcacaatagcaatagacagttagaaagaagtggaagatttggtggtaatccagttcatctcatttcaaatgtttatggaagaagcacttcattgaaagtagtgctgtaaatattctgccataggaatactgtctacatgctttctcattcaagaattcgtcatcacgcatcacaggccgcgtctttgacgttttgaataagtctgggtgaccgcacctaaaatgcacttgcactattactcagcagcagtaacatggtaacacttaaaatggtactcggggacctccaaagactaaactgacaagccttcaaggagcccagg

SEQ ID NO: 189192 - DNA, 929 bp, Homo sapiens
  Payload ID: 17356
  Gene Symbol: TARDBP
  Gene Name: TAR DNA binding protein
  ENST ID: ENST00000476201
  CDS Start-End: 103-929
attttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaaggctggacatggtggctcacatctgtaatcccagctactcgggaggctgaggcaggagaatcacttgaacccgggaggcagaggttgcagagaggggagattgcgccactgcactccagcctagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgc

SEQ ID NO: 189193 - DNA, 692 bp, Homo sapiens
  Payload ID: 17356
  Gene Symbol: TARDBP
  Gene Name: TAR DNA binding protein
  ENST ID: ENST00000496840
  CDS Start-End: 1-51
ctcatttcaaatgtttatggaagaagcacttcattgaaagtagtgctgtaaatattctgccataggaatactgtctacatgctttctcattcaagaattcgtcatcacgcatcacaggccgcgtctttgacgccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtgaaaatttttttttttcttttgaaatctagttttgaataagtctgggtgaccgcacctaaaatgcacttgcactattactcagcagcagtaacatggtaacacttaaaatggtactcggggacctccaaagactaaactgacaagccttcaaggagcccagggatgctggaaagttacctttaaaaattgagtctctaaagaaaaaagaaaataataaaaattgagtctcaagaagttgtacttcatatgcacaagagaaatgaggccaagactcacagtaagcttttacatggaatggtaacttttagttagactgaaaaacttgaatgttagctattaaaaccttttagg

SEQ ID NO: 189194 - DNA, 992 bp, Homo sapiens
  Payload ID: 17356
  Gene Symbol: TARDBP
  Gene Name: TAR DNA binding protein
  ENST ID: ENST00000621573
  CDS Start-End: 1-107
gtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatggtaagtatattgtaaaatacatatgtactaagaattttcaaaattggtttgttcagtgtggagtatattcagcagtatttttgacatttttctttagaaaaaggaagagctaaaggaattttataagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacgccctgaatgcaaagaattcatagcagttaattccccttttttgacccttttgagatggaactttcataaagtttcttggcagtagtttattttgcttcaaataaacttatttgaaaagttgtctcaagtcaaatggattcatcacctgtcatgcattgacacctgatacccagacttaattggtatttgttcttgcattggccaaagtga

SEQ ID NO: 189195 - DNA, 980 bp, Homo sapiens
  Payload ID: 17356
  Gene Symbol: TARDBP
  Gene Name: TAR DNA binding protein
  ENST ID: ENST00000617172
  CDS Start-End: 1-638
agacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgc

SEQ ID NO: 189196 - DNA, 657 bp, Homo sapiens
  Payload ID: 17356
  Gene Symbol: TARDBP
  Gene Name: TAR DNA binding protein
  ENST ID: ENST00000620505
  CDS Start-End: 1-347
gaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtagacagtggggttgtggttggttggtatagaatggtgggaattcaaatttttctaaactcatgttcatctcatttcaaatgtttatggaagaagcacttcattgaaagtagtgctgtaaatattctgccataggaatactgtctacatgctttctcattcaagaattcgtcatcacgcatcacaggccgcgtctttgacgcacttgcactattactcagcagcagtaacatggtaacacttaaaatggtactcggggacctccaaagactaaactgacaagccttcaaggagcccaggggtaagttaacttg

SEQ ID NO: 189197 - DNA, 682 bp, Homo sapiens
  Payload ID: 17356
  Gene Symbol: TARDBP
  Gene Name: TAR DNA binding protein
  ENST ID: ENST00000619555
  CDS Start-End: 1-415
tcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacgccctgaatgcaaagaattcatagcagttaattccccttttttgacccttttgagatggaactttcataaagtttcttggcagtagtttattttgcttcaaataaacttatttgaaaagttg

SEQ ID NO: 189198 - DNA, 816 bp, Homo sapiens
  Payload ID: 17356
  Gene Symbol: TARDBP
  Gene Name: TAR DNA binding protein
  ENST ID: ENST00000621715
  CDS Start-End: 87-816
gcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaa

SEQ ID NO: 189199 - DNA, 706 bp, Homo sapiens
  Payload ID: 17356
  Gene Symbol: TARDBP
  Gene Name: TAR DNA binding protein
  ENST ID: ENST00000620632
  CDS Start-End: 1-448
tcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccagttcatctcatttcaaatgtttatggaagaagcacttcattgaaagtagtgctgtaaatattctgccataggaatactgtctacatgctttctcattcaagaattcgtcatcacgcatcacaggccgcgtctttgacggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataa

SEQ ID NO: 189200 - DNA, 706 bp, Homo sapiens
  Payload ID: 17356
  Gene Symbol: TARDBP
  Gene Name: TAR DNA binding protein
  ENST ID: ENST00000622057
  CDS Start-End: 1-602
tggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtgtacaatatgaagccttcatttaatctctgcagttcatctcatttcaaatgtttatggaagaagcacttcattgaaagtagtgctgtaaatattctgccataggaatactgtctacatgctttctcat

SEQ ID NO: 189201 - DNA, 739 bp, Homo sapiens
  Payload ID: 17356
  Gene Symbol: TARDBP
  Gene Name: TAR DNA binding protein
  ENST ID: ENST00000611963
  CDS Start-End: 1-528
aaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtgttcatctcatttcaaatgtttatggaagaagcacttcattgaaagtagtgctgtaaatattctgccataggaatactgtctacatgctttctcattcaagaattcgtcatcacgcatcacaggccgcgtctttgacgccctgaatgcaaagaattcatagcagttaattccccttttttgacccttttgagatggaactttcataaagtttcttggcagtagtttattttgcttcaaataaacttatttgaaaagttgtctcaagtc

SEQ ID NO: 189202 - DNA, 1008 bp, Homo sapiens
  Payload ID: 17356
  Gene Symbol: TARDBP
  Gene Name: TAR DNA binding protein
  ENST ID: ENST00000621790
  CDS Start-End: 1-915
atgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcaggttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtccca

SEQ ID NO: 189203 - DNA, 563 bp, Homo sapiens
  Payload ID: 17356
  Gene Symbol: TARDBP
  Gene Name: TAR DNA binding protein
  ENST ID: ENST00000610369
  CDS Start-End: 1-384
tgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggaatactgtctacatgctttctcattcaagaattcgtcatcacgcatcacaggccgcgtctttgacggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaaataa

SEQ ID NO: 189204 - DNA, 515 bp, Homo sapiens
  Payload ID: 17356
  Gene Symbol: TARDBP
  Gene Name: TAR DNA binding protein
  ENST ID: ENST00000614494
  CDS Start-End: 1-236
gccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcataaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacgccctgaatgcaaagaattcatagcagttaattccccttttttgacccttttgagatggaactttcataaagtttcttggcagtagtttattttgcttcaaataaacttatttgaaaagtt

SEQ ID NO: 189205 - DNA, 920 bp, Homo sapiens
  Payload ID: 17356
  Gene Symbol: TARDBP
  Gene Name: TAR DNA binding protein
  ENST ID: ENST00000616545
  CDS Start-End: 1-906
atgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggaatactgtctacatgctttctcattcaagaattcgtcatcacgcatcacaggccgcgtctttgacggtgggtgtccca

SEQ ID NO: 189206 - DNA, 1031 bp, Homo sapiens
  Payload ID: 17356
  Gene Symbol: TARDBP
  Gene Name: TAR DNA binding protein
  ENST ID: ENST00000629725
  CDS Start-End: 135-1031
ggtgggcggggggaggaggcggccctagcgccattttgtgggagcgaagcggtggctgggctgcgcttgggtccgtcgctgcttcggtgtccctgtcgggcttcccagcagcggcctagcgggaaaagtaaaagatgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccagttcatctcatttcaaatgtttatggaagaagcacttcattgaaagtagtgctgtaa

SEQ ID NO: 189207 - DNA, 2389 bp, Homo sapiens
  Payload ID: 17357
  Gene Symbol: TOE1
  Gene Name: target of EGR1, member 1 (nuclear)
  Uniprot ID: Q96GM8
  ENST ID: ENST00000372090
  CDS Start-End: 584-2116
cgctcttacaccctgggcagcctcctccgatggcccactccccgcctctttcactttctggagatcactgagctctccatcctctctgggaatttaccgatgcccagaacgcccttctttcccccacacgaccctctcctagtctaactcctgggcgtgctttaagctcagctcaggcagcgtcaccttctctggaaagcccaaacccagccaccccactacccgctacccgcggcccacgctgatgaagacagcagaacacggaggccccgcgttcccgccgcgagagcaggagagaaagattacctcccgcgagctctagcgcgcccggctttccggcgcactccagggggcgtggctcgggtccacccgggctgcgagccggcagcacaggccaataggcaattagcgcgcgccaggctgccttccccgcgccggacccgggacgtctgaacggaagttcgacccatcggcgacccgacggcgagaccccgccccatccccgactgcctgaaccgcgccaggagacggaccgcaagtccagcgtacccacagacgactcaggcgggagacgagcggtgtcatggccgccgacagtgacgatggcgcagtttcagctcccgcagcttccgacggtggtgtcagcaaaagcacaacatctggggaggagctagtagtccaggttcccgtagtggatgtgcaaagcaacaacttcaaggagatgtggccatccctcctgctagccataaagacagctaatttcgtggctgtggacacggagctgagtgggcttggggacaggaagagtttgctgaaccagtgcattgaggaacgttacaaggccgtgtgtcatgctgccaggacccgttctatcctttccctgggcctcgcctgcttcaagcggcagccagacaagggtgaacattcctatctggctcaagtgttcaatctcactctgctgtgcatggaggagtatgtcatagaaccaaagtctgtgcagttcctgatacagcatggcttcaacttcaaccagcagtatgcccaaggcatcccctaccataagggcaatgacaagggtgatgagagccagagccagtcagtacggaccctattcctggagctaatccgagcccgccggcccctggtgctacacaatggccttatagacttggtgttcctgtaccagaacttctatgcacacctccctgagagtctgggaaccttcaccgctgacctgtgtgagatgttcccagcaggcatttatgacaccaaatatgctgctgagtttcatgcccgtttcgtggcctcctacttagaatatgccttccggaaatgtgaacgggaaaatgggaagcagcgggcagctggcagcccacaccttaccctggagttctgcaactatccttccagcatgagggaccatattgattaccgctgctgcctgcccccagcaacccaccgtcctcatcccaccagcatctgtgacaacttctcggcttatggctggtgccccctgggaccacagtgtcctcagtctcacgatattgaccttatcattgacactgatgaggctgcggcagaggacaagcggcgacggcgacgacgtagggaaaaacggaagagggctttattgaacctaccggggacacagacctctggggaagctaaggatggtcctcccaagaagcaggtctgtggggatagcatcaagcctgaagaaaccgagcaggaggtggctgccgatgaaactaggaacctgcctcactccaagcaaggcaacaaaaatgacttagagatggggattaaggcagcaaggcctgaaatagctgatagagctacctcagaagtgccagggagccaagccagtcctaacccagtgcctggggatggattgcaccgggctggttttgatgcctttatgacaggttatgtgatggcctatgtggaagtgagccagggaccgcagccctgcagctctggaccctggctccctgaatgccacaataaggtatatttgagtggcaaagctgtacccctcacagtggccaagagccagttctctcgttcctccaaagcccacaatcagaagatgaagctcacttggggcagtagctgatgcaacttccaccttgctctcaggtggaacagaggtattttgggtctctctagcctgaaatgtcatcctcaactgctactgagtttaggggagggggaatgtcttgacagacatcactgcattgccctggaccgcctcctttatcccagtgtttgaggtacaagtaagaaggctgaccagcacctgtaacactgactttatttttaagtctgaaaatgtcttgggaaagttttacaaaaaaaaaaatcaacagaagcaagttatgaaaatatt

SEQ ID NO: 189208 - DNA, 1895 bp, Homo sapiens
  Payload ID: 17358
  Gene Symbol: TOM1L1
  Gene Name: target of myb1 like 1 membrane trafficking protein
  Uniprot ID: O75674
  ENST ID: ENST00000348161
  CDS Start-End: 207-1406
gagtcgggagccggagagcggtggaggcggatttcctgggcccggccctctggcgctaccatggcgtttggcaagagtcaccgggatccctacgcgacctccgtgggccacctcataggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctgg

SEQ ID NO: 189209 - DNA, 2228 bp, Homo sapiens
  Payload ID: 17358
  Gene Symbol: TOM1L1
  Gene Name: target of myb1 like 1 membrane trafficking protein
  ENST ID: ENST00000445275
  CDS Start-End: 115-1512
agagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataatccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactatt

SEQ ID NO: 189210 - DNA, 1522 bp, Homo sapiens
  Payload ID: 17358
  Gene Symbol: TOM1L1
  Gene Name: target of myb1 like 1 membrane trafficking protein
  Uniprot ID: O75674
  ENST ID: ENST00000536554
  CDS Start-End: 81-1280
ctctggcgctaccatggcgtttggcaagagtcaccgggatccctacgcgacctccgtgggccacctcatagcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcag

SEQ ID NO: 189211 - DNA, 1524 bp, Homo sapiens
  Payload ID: 17358
  Gene Symbol: TOM1L1
  Gene Name: target of myb1 like 1 membrane trafficking protein
  ENST ID: ENST00000571319
  CDS Start-End: 14-205
ctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatggcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtcctta

SEQ ID NO: 189212 - DNA, 2442 bp, Homo sapiens
  Payload ID: 17358
  Gene Symbol: TOM1L1
  Gene Name: target of myb1 like 1 membrane trafficking protein
  Uniprot ID: O75674
  ENST ID: ENST00000570371
  CDS Start-End: 1320-2360
tgagtaaggaagttgataaacggcaacatctgaaatagctactcgccctgaataggcaggtggagaatattagttacacgtgggacaaatcccattatgagacatatcatcacaacaagaatatttcattctagattttagaatcccaggttttggctcactttggtcaagaaaaattataaataattgagttacagataattaaatgttagcctcctggagtgcatggcaattggttttgacctctatattaaaattcacaagaccacggacataagtcaaaacaggtccccttcgtctccctagtcaccatctccagggctaaaaaacagacttgaaatgggtggcagttagactacaggaaacaggatctacaagcaccaggagctcatctatggctatctgacatcgcctggggacacctcactctctggcaggctcctgctggctggagattgttaacatcgccaatcagatgttaattgaatgcaaaggaataggaaataaattctggttctgaaggggcagctggaaaggtgttgggcttctcagattccaacctacattacaaagcaggcctaaagccaagcatactccttgccagaagaaacggaaagcccctctcccgtttttagaatcaggctggaaaacacggctcccagaaggtggggttagaaaacaagagcttgcgaggcggcgccctgtggtccctcgaggaaatagtagagagacaaagagggcctgctcctgggaagccctaaattcgaagccaatccttcctcctagacatgaccacaactttaaagggcagggcgcacacctcccctcccggatctctaggacaaagggcagccaaagaggcgcagagaagaatgacaaggtgcccagcaagcggcaggatcaaagcctgggtctctaattcccaggctggagattctgggctgcctgctcctcctgcacggggcgaaaagcccacctgggatccgagcgggcggccgcgccactctcgcaggctccatacacccgccactacccgcctgtaccacctgcagccggcagcgcagcctcctcgcgggtcccgcagggcgcgctgcaggtgcgctgggcgtcccgaagccccgccctcgcgtccctgccccgcgcccagctcctcacgctcggtgcccgcgccccgcagcggcagcgcagaacgcaccgcctctgccagagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaagtaaataaacactcaggtcttttcagaccagcagaagagcttgatgttaaacagttctccttaattacgtgattaaataccacctaagaa

SEQ ID NO: 189213 - DNA, 754 bp, Homo sapiens
  Payload ID: 17358
  Gene Symbol: TOM1L1
  Gene Name: target of myb1 like 1 membrane trafficking protein
  ENST ID: ENST00000572576
  CDS Start-End: 1-754
caagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcaacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaat

SEQ ID NO: 189214 - DNA, 1849 bp, Homo sapiens
  Payload ID: 17358
  Gene Symbol: TOM1L1
  Gene Name: target of myb1 like 1 membrane trafficking protein
  Uniprot ID: O75674
  ENST ID: ENST00000575333
  CDS Start-End: 10-1050
ggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaagtaaataaacactcaggtcttttcagaccagcagaagagcttgatgttaaacagttctccttaattacgtgattaaataccacctaagaaggactgaagtcaggttgaatgtcagagcgctatgttaggagatgtgattacttcccggcaaatggttgagtcaaacccagtatagcaatgggatgtgtctgggcgaggaggtccttgaaactcatcctactcacttagaatctcatggaattcacctggcctgctttgtagaagttgttcagcccaatggccaatacttaaagtctactgtgaacctacacactattatcattgggtttttctgctatacctcagcatcaggtaagggagtatctctgatgcaagcggagaaattcagggattacaaggtatgaactgagtggttgtgaaatgtagaaggaaaaacacaggctttaaagtcagagaagtccaagttgaaatgccagttctgccacctctcagccacctaacttttgagagtctcactttataaaatgggaacaatgattgccttaaagggtggttgtcaaggttaacaaactaatgtttataaaatgcattgtagcaaagcttacaatgcattttataaacatttataaaagagttacctatcttacctgttatcttctgctgtccttattcccagcaagggtttggcaaattacaaaataaggatgatgaaaaatgctgaaatccagttttgtcaaattaaaagcagtttgtttttctcatatgtcatctgctgtttccggagtaaaaatattcagtatcactgaa

SEQ ID NO: 189215 - DNA, 567 bp, Homo sapiens
  Payload ID: 17358
  Gene Symbol: TOM1L1
  Gene Name: target of myb1 like 1 membrane trafficking protein
  ENST ID: ENST00000572298
  CDS Start-End: 248-567
ctctggcgctaccatggcgtttggcaagagtcaccgggatccctacgcgacctccgtgggccacctcataggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcatcacgttgcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctct

SEQ ID NO: 189216 - DNA, 1026 bp, Homo sapiens
  Payload ID: 17358
  Gene Symbol: TOM1L1
  Gene Name: target of myb1 like 1 membrane trafficking protein
  ENST ID: ENST00000570965
  CDS Start-End: 145-261
agcggcagcgcagaacgcaccgcctctgccagagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagctcagactcaacagctttttcttggcagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagag

SEQ ID NO: 189217 - DNA, 708 bp, Homo sapiens
  Payload ID: 17358
  Gene Symbol: TOM1L1
  Gene Name: target of myb1 like 1 membrane trafficking protein
  ENST ID: ENST00000575909
  CDS Start-End: 21-708
aaaaatgtaccttcctttcgatgccgcctggggagtggaaccaaacagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgc

SEQ ID NO: 189218 - DNA, 576 bp, Homo sapiens
  Payload ID: 17358
  Gene Symbol: TOM1L1
  Gene Name: target of myb1 like 1 membrane trafficking protein
  ENST ID: ENST00000572360
  CDS Start-End: 4-282
accatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcatcacgttgcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattg

SEQ ID NO: 189219 - DNA, 2337 bp, Homo sapiens
  Payload ID: 17358
  Gene Symbol: TOM1L1
  Gene Name: target of myb1 like 1 membrane trafficking protein
  ENST ID: ENST00000572405
  CDS Start-End: 133-810
ggatttcctgggcccggccctctggcgctaccatggcgtttggcaagagtcaccgggatccctacgcgacctccgtgggccacctcataggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcaggtgttgtacgatttcagggactatcagtcaaagtgtctcttaaagttattctctaaactttgagtttggagatggaagacaccttaatattgtctagtacatcctcctacatcctgatttcagttgatttctaaacttaacaaaaatatccaagaatgactttgtcagaaatgcagtagtaacttagacatggtttttagcctcttgcaacaaataatttattataagttataaccttggtcatgtacaatcaattctctagttgttttaagtatgtaaaaattgcctctattttcatccactcaacaaacattgagtaactgtgatataggaagggatgtagaaatgagaaggaggctattctagtccttaagagtttatgcctaatgagcaagattggtttgtaaacaacaaacataatgaagtattatagatactgtagtataaatttgttcagtatatggtgggatcatgggtggggagaaggagagatgtgaggtttttaagaatggtctagatggaggcaatgctcgagctatagaggaacaagtagacagggcatttagacctgcatgagtagttctacagccctcctatgccttctgctatgtctgtgtatacatatactttatttttccctctaccagtttgctcttctaattattttaaattttaaaacttattaattttagaagcagttagaaaaaaaaatcagtttctagtttctaagtccctttgttgccaagttaagaagcttaagatatttttacttttctcagattcccactcgccacctctcatgttatttttcctttaacttcttagattgttagtaaataactttttccttgctcatttcttatttgggaaacaaaaaaattgtaaaaattttcccaacaatgtttcttagatatcactgctgtcgtgaatagtttgttttttccttgctgcagtacacccatgttggtaaactttggtgcaaactttgagtgcttgcatatccaaaaatgtcctctgattgtcatgttaaatgcaggttagtttagctagatataaaattctaggcacaaaattctaggcctttgaagatactgcttcactgttctcttacacccactaatgctgatagaagtattatattattctgcttcttaatcctttgattaataatatttttttctagttgcatttgttatttttctacgttaatatttcagaaattgtactgttccctctgaagagatatatgtacatgtgtgcagatgtttgtttaacttacttatcttccttagtagatgataggcttttttgccttatcaacttatgtgtatttttaattctaggaattctcagctcctactttaaatattgactttctaccattctttctattctcttcttatggaactttaagacgatgaaacttccagttggattcatttgtctcttaacatttcttttatacttttcatttcttcattctaagttctgggataatttctctgtttaatgtatttctctaaaacttgtaattgagttgcttattcagtccttctaataaatgtttcaacaatttctttctattaaaaa

SEQ ID NO: 189220 - DNA, 2507 bp, Homo sapiens
  Payload ID: 17358
  Gene Symbol: TOM1L1
  Gene Name: target of myb1 like 1 membrane trafficking protein
  Uniprot ID: O75674
  ENST ID: ENST00000575882
  CDS Start-End: 354-1784
aaaagcccacctgggatccgagcgggcggccgcgccactctcgcaggctccatacacccgccactacccgcctgtaccacctgcagccggcagcgcagcctcctcgcgggtcccgcagggcgcgctgcaggtgcgctgggcgtcccgaagccccgccctcgcgtccctgccccgcgcccagctcctcacgctcggtgcccgcgccccgcagcggcagcgcagaacgcaccgcctctgccagagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaacaa

SEQ ID NO: 189221 - DNA, 596 bp, Homo sapiens
  Payload ID: 17358
  Gene Symbol: TOM1L1
  Gene Name: target of myb1 like 1 membrane trafficking protein
  ENST ID: ENST00000570499
  CDS Start-End: 1-596
cgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagattggaaaactgcacagtgaattggatatggtgaaaatgaatgtgcgagtgatgtccgccatattgatggagaatactcctgggtctgaaaaccatgaagac

SEQ ID NO: 189222 - DNA, 1521 bp, Homo sapiens
  Payload ID: 17358
  Gene Symbol: TOM1L1
  Gene Name: target of myb1 like 1 membrane trafficking protein
  ENST ID: ENST00000572158
  CDS Start-End: 31-1440
atttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcaaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcct

SEQ ID NO: 189223 - DNA, 556 bp, Homo sapiens
  Payload ID: 17358
  Gene Symbol: TOM1L1
  Gene Name: target of myb1 like 1 membrane trafficking protein
  ENST ID: ENST00000573607
  CDS Start-End: 191-556
ttggccaactcactgtagaacctcagtcctcaaaaatgtaccttcctttcgatgccgcctggggagtggaaccaaacaggtgaaccgcgggagtcaggcatggagtgtttgggcctccacgaggagacaccagaaacttctcgaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaa

SEQ ID NO: 189224 - DNA, 1252 bp, Homo sapiens
  Payload ID: 17358
  Gene Symbol: TOM1L1
  Gene Name: target of myb1 like 1 membrane trafficking protein
  ENST ID: ENST00000576932
  CDS Start-End: 100-1080
ggatttcctgggcccggccctctggcgctaccatggcgtttggcaagagtcaccgggatccctacgcgacctccgtgggccacctcatagcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagataccccctagagacctggttttaccatgttggccaggctgtggtctcaaactcctgacctacggtgatctgcccacctcggcttcctgaagtgctgggattacaggcatgagccactgtgcccggctcataggccatatttatgacccatttactaacaggcaacaagctaagaagtatagaaatgcttactaattacttaacctatgaggtttgcccaaaggaccagccaaaacctcacctcaagccacgcatatgataa

SEQ ID NO: 189225 - DNA, 552 bp, Homo sapiens
  Payload ID: 17358
  Gene Symbol: TOM1L1
  Gene Name: target of myb1 like 1 membrane trafficking protein
  ENST ID: ENST00000574318
  CDS Start-End: 1-377
atttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagagtatattttccagctacagacatatgtaagacgcatataaagaattgaatgggcctggcatggtggcttatgcctctaatcccaacattttgagaggctgaagtggaaggatcacttgaacctgggaggtcgaagctgcaataagccatgattgcaccactgcactccagcctgggtgacagtgaccctgtctcaaaaaaaagaaaaaagaaaaa

SEQ ID NO: 189226 - DNA, 2259 bp, Homo sapiens
  Payload ID: 17359
  Gene Symbol: TOM1L2
  Gene Name: target of myb1 like 2 membrane trafficking protein
  Uniprot ID: Q6ZVM7
  ENST ID: ENST00000318094
  CDS Start-End: 85-1473
agtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagccccaggcagtgcttcctgagcagaccacccggactgtctttcctccacccgcccatggagaaagagcacgcccggccccgccctgtgctcacctctgcctggctcagcgaccttctcaggcattctgccctcctgggcccctctctccctgaaggggctttgtggcatctctggaagagcagggtgtgctgcactcatgggcctggtctcactccttggacttgtcaccttgtgacatttggcttatcagcatttgagaaggctctgctgggtctccatggtgggggtctctcaccttcttgaccctctctccatcattcagctgccagcccaggcttcacacccaagctggctcagcagccgagcctggcaccgagggtccctgcaggctccctgggcagggagagggccaaggacaattgggagggcagcaggcagcccgcagatggtggccatgtggcacgctgctgagacgacactaccaataaaccaaactgccacgc

SEQ ID NO: 189227 - DNA, 2418 bp, Homo sapiens
  Payload ID: 17359
  Gene Symbol: TOM1L2
  Gene Name: target of myb1 like 2 membrane trafficking protein
  Uniprot ID: Q6ZVM7
  ENST ID: ENST00000379504
  CDS Start-End: 85-1608
agtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagccccaggcagtgcttcctgagcagaccacccggactgtctttcctccacccgcccatggagaaagagcacgcccggccccgccctgtgctcacctctgcctggctcagcgaccttctcaggcattctgccctcctgggcccctctctccctgaaggggctttgtggcatctctggaagagcagggtgtgctgcactcatgggcctggtctcactccttggacttgtcaccttgtgacatttggcttatcagcatttgagaaggctctgctgggtctccatggtgggggtctctcaccttcttgaccctctctccatcattcagctgccagcccaggcttcacacccaagctggctcagcagccgagcctggcaccgagggtccctgcaggctccctgggcagggagagggccaaggacaattgggagggcagcaggcagcccgcagatggtggccatgtggcacgctgctgagacgacactaccaataaaccaaactgccacgcacacactgcaggctcacacccgca

SEQ ID NO: 189228 - DNA, 1766 bp, Homo sapiens
  Payload ID: 17359
  Gene Symbol: TOM1L2
  Gene Name: target of myb1 like 2 membrane trafficking protein
  Uniprot ID: Q6ZVM7
  ENST ID: ENST00000395739
  CDS Start-End: 92-1480
aagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagcccc

SEQ ID NO: 189229 - DNA, 1420 bp, Homo sapiens
  Payload ID: 17359
  Gene Symbol: TOM1L2
  Gene Name: target of myb1 like 2 membrane trafficking protein
  ENST ID: ENST00000540946
  CDS Start-End: 85-1254
agtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagct

SEQ ID NO: 189230 - DNA, 1748 bp, Homo sapiens
  Payload ID: 17359
  Gene Symbol: TOM1L2
  Gene Name: target of myb1 like 2 membrane trafficking protein
  Uniprot ID: Q6ZVM7
  ENST ID: ENST00000535933
  CDS Start-End: 108-1559
agagtggggagggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagctgaagaggaaaggggttgaatttcccatggcagacttggacgctctgtctcccatacacacaccacagcggattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggacttttctgtcctcggcccagaagagaggtagaggtggggagtctgacctggagcccatagacagctggcttataacccaaggaatgatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagt

SEQ ID NO: 189231 - DNA, 1320 bp, Homo sapiens
  Payload ID: 17359
  Gene Symbol: TOM1L2
  Gene Name: target of myb1 like 2 membrane trafficking protein
  ENST ID: ENST00000542206
  CDS Start-End: 88-1254
gtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacaattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggacttttctgtcctcggcccagaagagaggtagaggtggggagtctgacctggagcccatagacagctggcttataacccaaggaatgatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactg

SEQ ID NO: 189232 - DNA, 2098 bp, Homo sapiens
  Payload ID: 17359
  Gene Symbol: TOM1L2
  Gene Name: target of myb1 like 2 membrane trafficking protein
  Uniprot ID: Q6ZVM7
  ENST ID: ENST00000478943
  CDS Start-End: 566-1288
caatccagaccacgtctggcaggccccaaggcccaggcagctttttgagagcccctctcctgcctggcctggggacatgagccattcacaacagaggagagttggccacaaaaagagagaccacaatctaaatgtccagcaatagaagaatggcgagatacattatgaaacacacagaaaggaatgaggcagtctgtaccaagtgatggagaacggtgtctggaatattttgttgagaaaaagcaatctggaaagaatcacattttaatattttttaatgatttgtacaagcatgtacttgtatacatacaacagtatgtctggacatttgtctgctgaaaaagtacttgtttcctctgcggaaggaggggcaggcagtgaagagggaacttctactttgaattcggcacatgtctggttttatgaacaagcatgtactccttttgtgacttttaagaatcagtacaaattttttcaaaggagatagaatgtgacgaaaagcacacccagcaggctacccagaggtgcatgtgttccctaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagccccaggcagtgcttcctgagcagaccacccggactgtctttcctccacccgcccatggagaaagagcacgcccggccccgccctgtgctcacctctgcctggctcagcgaccttctcaggcattctgccctcctgggcccctctctccctgaaggggctttgtggcatctctggaagagcagggtgtgctgcactcatgggcctggtctcactccttggacttgtcaccttgtgacatttggcttatcagcatttgagaaggctctgctgggtctccatggtgggggtctctcaccttcttgaccctctctccatcattcagctgccagcccaggcttcacacccaagctggctcagcagccgagcctggcaccgagggtccctgcaggctccctgggcagggagagggccaaggacaattgggagggcagcaggcagcccgcagatggtggccatgtggcacgctgctgagacgacactaccaataaaccaaactgccacgcacacactgcaggctcacacccgca

SEQ ID NO: 189233 - DNA, 5595 bp, Homo sapiens
  Payload ID: 17359
  Gene Symbol: TOM1L2
  Gene Name: target of myb1 like 2 membrane trafficking protein
  Uniprot ID: Q6ZVM7
  ENST ID: ENST00000581396
  CDS Start-End: 98-1471
gggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggttcgaacgatacaggtctggccgatccgttcaaaatgccagtaatggagtactgaatgaagtaaccgaagacaacttaatagacctggggccagggtctccagccgtggtgagcccaatggtggggaacacagcgcccccatcttccctctcctcccagcttgcaggcttagacttggggacagagagcgtcagtggcaccctcagttcactccagcaatgtaatccccgtgacggctttgacatgtttgcccagacgagaggaaactccttggctgagcagcgcaagacggtaacctatgaggatcctcaggctgtcggaggacttgcttctgcactagacaatcgaaaacagagttcagaagggatccccgttgcgcagccatctgtcatggacgacattgaggtgtggctcaggaccgacctgaagggtgatgatctggaggagggtgtcacaagtgaagagtttgataaattccttgaagaaagagccaaagctgctgaaatggttcccgacctcccctcgccccccatggaggctcctgccccagcctcaaacccttctggccggaagaagccagagcggtcagaggatgccctcttcgccctgtgagcagctctgtggtttgcctccccagatggcgggtccccgctcgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactgcagccagagactctctcccctcccaccatgggcccctctgcccatgtttcctcccaggaagagcgggcagagtggcccagccccaggcagtgcttcctgagcagaccacccggactgtctttcctccacccgcccatggagaaagagcacgcccggccccgccctgtgctcacctctgcctggctcagcgaccttctcaggcattctgccctcctgggcccctctctccctgaaggggctttgtggcatctctggaagagcagggtgtgctgcactcatgggcctggtctcactccttggacttgtcaccttgtgacatttggcttatcagcatttgagaaggctctgctgggtctccatggtgggggtctctcaccttcttgaccctctctccatcattcagctgccagcccaggcttcacacccaagctggctcagcagccgagcctggcaccgagggtccctgcaggctccctgggcagggagagggccaaggacaattgggagggcagcaggcagcccgcagatggtggccatgtggcacgctgctgagacgacactaccaataaaccaaactgccacgcacacactgcaggctcacacccgcacacctggtcctggcttgtggagggacttgcactggaggtattgctctggcttgcctggggaagtgtcacagatgtgcacatgggccacactcagtgctgtggcctggcctgccgtagcctcacacatctgcctcaagagccagcagcaaacagctttgtggcatccttggaggttcccagtgactgagaggcctgggcagcactaaggcccctgctctgctccctggcataggccttggcctccttgcacagactctcctgacagtctggcctcctcccacctcagaggtcctctggccaccaatttatactctctccccaagctgatcctgaaggcaggcagagcagctaggggctggtaacatgtattcccatcccgtgtcctcactggtgtgtctcctggccatgggcaagggactcgggtcatcccaggccctggtccagccagacacctggccccacacctcccaccaggctgctgttgctcagaaggagaatactgcagctgtatgcatccccgtgtgtcttgggcccagctcgctgggtcagtctgctcctgtcccctccagcatgcactgcctaggtcagcacaggttcctgatccatggtgtagttagcccttcccacctggcaggacggcccagaccaccagccaagcagggaaagggggctgggcttgacgggagaagagaccagcgacatggtcgttggggagcattcaggatggcgacttcagctgggggtcatgctgagcaccaacaggaactattccagtgaagagcaagtgctgcccgacccaggaccctgtgccaggctagcagccctccagctccctccagagaggaaacctctgtctggctgagggtgggactagctgggatgtctcactccagttgctcaggttcacccaggaagctcctccgtggagtggccagcctgattctagccctgtcctctctggcagcacatgccacacctgcctgggccttctgctccctgatgcttgatgagcccctgcctcctcaatgtttctcaaagacagacccccctgaggccagcttgaatgtgaagactgctgaagttagctggcttcacttgagctgcagaaaaggtggctgggatggcccaggtgcacccagaggccccagccctttggctgcctttgggttgtgacttgggttgtctctgaggccctgccagagctgggcctgcgggtggtgggcggtccgacctcgggcagtcagtgctccgcagcctcagcactgcatcccagacccagtgtcctcagagggaagagccagcctccctgcctcatggaaccaggagtcccaaaaagtcaggagcctggaggctctgaaaggagcagggattccatagtgcgtgaagctgaaataggcgccctcctggggagcccccagcaaaactgtttttcatacccactcccagaactgccccgctccagctccagcgccagcgccagctggttgccaggcatcattggagaggcctggctgccccaggggcagcagggagtggtggacctgtatgggctggcaggaggccattggccatgctgacaagtgtcacctgccttcctagcctggagccacccctcaggtggcctgcttgcacctcctatccggaggtagcctgccccacctgtaggcagagggggctcttgcttgaggcctgcacaggaagcaagtatagccccggtgccccagagtgggttccacttagccctggcgagatggcctgtcctgagatctctgctcccagaccccaccatctggggagcacagtccttaggctgcctggtccaggaagggggtgcggctctgtcaggaaacctggactctcaaggcccaccagcctctccgtgagtgttagaaatcacagatacagtatatacttaattacactaaattattgctgggattccttataagcactaattatacctgattataggttaaaatatttattttgtcaaaatattttcttgggaatgtgtttaaccctttctgcgttcattgttgctgagatgtgaaaactaaccattccctcctgcctacctttttggccactgggcggcagagaatggcgctatgtgcagttgggcccctggcaccatgggcctttggcctgcctgctgcagagtagccctgcctgggcagtctccaggcactgagcaggccatctgtggccaggctgagagaatgactggctcgcttaccagcgtgcatgggacaaggagctttggagcctcaaggggttgttgctggcctgggctagagggaaaggtgaccatccgtctgtcctcctgtctttctattagcgcctccatgtgagtgatggtgccttggttcactagccttcccccaccaccccaccatgccacctggtggtcttggggcctgtgctgtcactccagcccctggggaggagaggacccagcccggagagttggggcaagggctccacatggcccaagggcaacagatgctcgcagggcagctgctgccgatgctcacgctcctgcccccctccttcccgctgccacaccccaccctgggcccccgcagacacgcatctctaactcagttgggcccagccttctggatggcttggggtaggccatgggcccacctggggccaggccagcccctggggcagctctggaagagcagtgtggaggagcacttgcttgcagcctggcttcagcctctggcactgctggagtggtccctgggagcttctgcactgtcggctttggggacgtctcacccacttgggttacagtaggccttccccacccagagagaagtgtttccaccccagagacattgtctgtcagcccctgaagtgctcgcctcccccagtgcccgtcaccagcccttcctatctgtggggtccaagtcaggcttcccctgcggccaccagccatagggagcagccatcagcccccgagtcagaactgcttctgtctgtccatacctccaggctctcccggagagggggacggatatttatttcctaaagtttgcacttaattgtgaggattctcaggattgttgggggctactgaaaagaggaatgtgttgaatgtcgcgtttgctgtccactcgtcctagaagtttagtgtttttgtcactgtcatgtgtttctgtgggcagagctggttctggagggtgggtcagtgcacccgaggctcagagcatccatccaccccactggccctccttccagataccctctctctaattgggttcttgcatgtaaaatactccacaataaataaataattgaacaaa

SEQ ID NO: 189234 - DNA, 575 bp, Homo sapiens
  Payload ID: 17359
  Gene Symbol: TOM1L2
  Gene Name: target of myb1 like 2 membrane trafficking protein
  ENST ID: ENST00000468944
  CDS Start-End: 1-120
gacatgtttgcccagacgagaggaaactccttggctgagcagcgcaagacacaccaccctgcctggcccctcatccacaggagaagcttggaagcaggagggtgcagccatgcagggtgaacccattccttacagcgagattttcctgactaaaataagtggtcagagcagaggctcctctgatagcagctctggctaggatgagccatctggaattcagggagttgattccaaaagagagaatctcctacatctcagggaggcactgtacatgttttgagctttctgttcagcctaaaggcgggtgaaacacactttttcccacctttcccagggacccagcatcttggtgcactcagcaccctgagtcctgcttggggctcagtagggtaagcagaaacccaaggtcccatgtacccttcaccaccaaaggttgattgtaaaacagatatagctaaaggagtcggagagtggaggaagacctcccataatcagtgacaggcccgggtcccagagaccaccttccctgtcaaatgccactgaggctgctgctaataaaataagaattaatgtta

SEQ ID NO: 189235 - DNA, 453 bp, Homo sapiens
  Payload ID: 17359
  Gene Symbol: TOM1L2
  Gene Name: target of myb1 like 2 membrane trafficking protein
  ENST ID: ENST00000579586
  CDS Start-End: 204-453
agagagtggggagggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaag

SEQ ID NO: 189236 - DNA, 1300 bp, Homo sapiens
  Payload ID: 17360
  Gene Symbol: TOM1
  Gene Name: target of myb1 membrane trafficking protein
  ENST ID: ENST00000382034
  CDS Start-End: 61-690
gtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacacccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaacc

SEQ ID NO: 189237 - DNA, 560 bp, Homo sapiens
  Payload ID: 17360
  Gene Symbol: TOM1
  Gene Name: target of myb1 membrane trafficking protein
  ENST ID: ENST00000395736
  CDS Start-End: 40-441
agctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgg

SEQ ID NO: 189238 - DNA, 2622 bp, Homo sapiens
  Payload ID: 17360
  Gene Symbol: TOM1
  Gene Name: target of myb1 membrane trafficking protein
  ENST ID: ENST00000404284
  CDS Start-End: 74-283
acgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtgactctgctgctggaggtccaggggccacaggttgtgagtccctgctaagcaatgggctaggaagattctgatgtgatcagaacctggctggatacacaaaacagtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacgagacaggggtctcactgtgttgcccaggctagtctcaaactcttggcctcaagcagtcctccctccttggcctccgaaagcattggtattacaggcatgagccaccacacccacctgcccaccttgtatcattctgttcaagagtcacatccccaagagagacttggattggctgagcttcattgtgcctaccagctggggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaacca

SEQ ID NO: 189239 - DNA, 567 bp, Homo sapiens
  Payload ID: 17360
  Gene Symbol: TOM1
  Gene Name: target of myb1 membrane trafficking protein
  ENST ID: ENST00000443206
  CDS Start-End: 114-567
agtgtgttcagaagcacagaagcctgaggagggtgatggggtggctgcgggcgatcagctgagctgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgact

SEQ ID NO: 189240 - DNA, 593 bp, Homo sapiens
  Payload ID: 17360
  Gene Symbol: TOM1
  Gene Name: target of myb1 membrane trafficking protein
  ENST ID: ENST00000449508
  CDS Start-End: 36-329
gattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaagggtgctcgacggcacctctcggccctccaggtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccat

SEQ ID NO: 189241 - DNA, 1133 bp, Homo sapiens
  Payload ID: 17360
  Gene Symbol: TOM1
  Gene Name: target of myb1 membrane trafficking protein
  ENST ID: ENST00000456128
  CDS Start-End: 130-1133
gagcttcgcggtgccaccgccccgcccacgcctcctcgccggcctccgagtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcagg

SEQ ID NO: 189242 - DNA, 2389 bp, Homo sapiens
  Payload ID: 17360
  Gene Symbol: TOM1
  Gene Name: target of myb1 membrane trafficking protein
  Uniprot ID: O60784
  ENST ID: ENST00000449058
  CDS Start-End: 126-1604
ttcgcggtgccaccgccccgcccacgcctcctcgccggcctccgagtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtcaa

SEQ ID NO: 189243 - DNA, 2252 bp, Homo sapiens
  Payload ID: 17360
  Gene Symbol: TOM1
  Gene Name: target of myb1 membrane trafficking protein
  Uniprot ID: O60784
  ENST ID: ENST00000425375
  CDS Start-End: 126-1469
ttcgcggtgccaccgccccgcccacgcctcctcgccggcctccgagtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtc

SEQ ID NO: 189244 - DNA, 800 bp, Homo sapiens
  Payload ID: 17360
  Gene Symbol: TOM1
  Gene Name: target of myb1 membrane trafficking protein
  ENST ID: ENST00000439512
  CDS Start-End: 56-307
gctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtgctcgacggcacctctcggccctccaggtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgac

SEQ ID NO: 189245 - DNA, 2211 bp, Homo sapiens
  Payload ID: 17360
  Gene Symbol: TOM1
  Gene Name: target of myb1 membrane trafficking protein
  ENST ID: ENST00000424387
  CDS Start-End: 46-123
gctgtcagctgattcccggggttggtggcagcggcggtagcagcaatggactttctcctggggaacccgttcagctctccagtgggacagcgcatcgtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaagaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgcta

SEQ ID NO: 189246 - DNA, 2317 bp, Homo sapiens
  Payload ID: 17360
  Gene Symbol: TOM1
  Gene Name: target of myb1 membrane trafficking protein
  Uniprot ID: O60784
  ENST ID: ENST00000447733
  CDS Start-End: 152-1534
gctttttgccatcctgggcgctagagggaattgcgctgcaattcattaaattgcctctcagtctcaacagatgacaaaccccttgcccttgcctctgatttaagagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaaggtaaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtc

SEQ ID NO: 189247 - DNA, 2390 bp, Homo sapiens
  Payload ID: 17360
  Gene Symbol: TOM1
  Gene Name: target of myb1 membrane trafficking protein
  Uniprot ID: O60784
  ENST ID: ENST00000411850
  CDS Start-End: 126-1607
ttcgcggtgccaccgccccgcccacgcctcctcgccggcctccgagtgcgtcacgtgacgggtcggtggcgctggcggttgctgtcagctgattcccggggttggtggcagcggcggtagcagcaatggactttctcctggggaacccgttcagctctccagtgggacagcgcatcgagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagaggaccgtgttcaactcagagacacaatcaggacaggattctgtgggcactgactccagccagcaagaggactctggccagcatgctgcccctctgcccgccccgcccatactctccggtgacacgcccatagcaccaaccccggaacagattgggaagctgcgcagtgagctggagatggtgagtgggaacgtgagggtgatgtcggagatgctgacggagctggtgcccacccaggccgagcccgcagacctggagctgctgcaggagctcaaccgcacgtgccgagccatgcagcagcgggtcctggagctcatccctcagatcgccaatgagcagctgacagaggagctgctcatcgtcaatgacaatctcaacaatgtgttcctgcgccatgaacggtttgaacggttccgaacaggccagaccaccaaggccccaagtgaggccgagccggcagctgacctgatcgacatgggccctgacccagcagccaccggcaacctctcatcccagctggcaggaatgaacctgggctccagcagtgtgagagctggcctgcagtctctggaggcctctggtcgactggaagatgagtttgacatgtttgcgctgacacggggcagctcactggctgaccaacggaaagaggtaaaatacgaagccccccaagcaacagacggcctggctggagccctggacgcccggcagcagagcactggcgcgatcccagtcacccaggcctgcctcatggaggacatcgagcagtggctgtccactgacgtgggtaatgatgcggaagagcctaagggggtcaccagcgaaggtaaatttgacaaattcctggaagaacgggccaaagccgcggaccgattgcccaacctctccagcccctcagctgaggggcccccgggtcccccatctggcccagcgccccggaagaagacccaggagaaagatgatgacatgctgtttgccttatgagtgtggggtctggcaccctgcagcccaggtccccactgctctcacacccttaggctgggacctccctccctcctctggtgttaaggctgctttgggggtggcttgttacccccttttcctcctctttgaagacggagctgccccagctgtggctgggggtgtggaggcagtgggatgaactgggggacaggtctgcgctgcagtgggatctggctgctctgcctcctttcccaccccagctgaccatgagactttgctgagaagtggaggccccaggacaggctggctggctggctggctgcttgacccagtgtgactctccttcactgagtgataccctgctccgggcccatgccccaaggagcccttcagagcccacactgccagtcgaggcctggctggaggctggccacagtggaaattctgccgagcctcttgtcccttccctgctctgctgcatggggccccatggctttggctggccactgagggtagggtgtggaggtgtggaggccccctgaggagctgcggcggcccaggtacgaagctgcaactctgcgcgcagtgggcgagatctcatcagccccaggctgcaggtgaggcttcaggggatgctggggccccactgcccctccgctgccttgccctccatccttcctctgttccttctggccgggcaccacagcactggggctcacctcttggttgatcctcttgtactgggagaggtgccttttgtatccccaattaaaggtagaaaaccaccctgctagcagcattgtc

SEQ ID NO: 189248 - DNA, 553 bp, Homo sapiens
  Payload ID: 17360
  Gene Symbol: TOM1
  Gene Name: target of myb1 membrane trafficking protein
  ENST ID: ENST00000608749
  CDS Start-End: 152-553
gctttttgccatcctgggcgctagagggaattgcgctgcaattcattaaattgcctctcagtctcaacagatgacaaaccccttgcccttgcctctgatttaagagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatgctgtcacccatccacacaccccagagg

SEQ ID NO: 189249 - DNA, 541 bp, Homo sapiens
  Payload ID: 17360
  Gene Symbol: TOM1
  Gene Name: target of myb1 membrane trafficking protein
  ENST ID: ENST00000608674
  CDS Start-End: 167-541
aaggtaagataatttgggctgcgagcagggtgcatcttggagcggggagaccttgacatcaaacaggaagagtcttaccgggacaaggagacaacagcccagagaggctgtcacccaggagaaagccacagatggctccctgcagagcgaggactgggccctcaacatggagatctgcgacatcatcaacgagacggaggaaggtcccaaagatgccctccgagcagtaaagaagagaatcgtggggaataagaacttccacgaggtgatgctggctctcacagtcttagaaacctgtgtcaagaactgcgggcaccgcttccacgtgctggtggccagccaggacttcgtggagagtgtgctggtgaggaccatcctgcccaagaacaacccacccaccatcgtgcatgacaaagtgctcaacctcatccagtcctgggctgacgcgttccgcagctcgcccgatctgacaggtgtggtcaccatctatgaggacctgcggaggaaaggcctggagttccccatgactgacctggacatg

SEQ ID NO: 189250 - DNA, 2352 bp, Homo sapiens
  Payload ID: 17361
  Gene Symbol: TASP1
  Gene Name: taspase, threonine aspartase, 1
  Uniprot ID: Q9H6P5
  ENST ID: ENST00000337743
  CDS Start-End: 122-1384
gggcgggtgactacttccggtgcagtgaaggctcggggctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggcaattgaaaagctgcaggccggtgctcttgcaactgacgcagtcactgcagcactggtggaacttgaggattctccttttacaaatgcaggaatgggatctaatctaaatctgttaggtgaaattgagtgtgatgccagcataatggatggaaaatccttaaattttggagcagttggagcactgagtggaatcaagaacccagtctcggttgccaacagactcttatgtgaagggcagaagggcaagctctcggctggcagaattcctccctgctttttagttggagaaggagcctacagatgggcagtagatcatggaataccctcttgccctcctaacatcatgaccacaagattcagtttagctgcatttaaaagaaacaagaggaaactagagctggcagaaagggtggacacagattttatgcaactaaagaaaagaagacaatcaagtgagaaggaaaatgactcaggcactttggacacggtaggcgctgtggttgtggaccacgaagggaatgttgctgctgctgtctccagtggaggcttggccttgaaacatccggggagagttgggcaggctgctctttatggatgtggctgctgggctgaaaatactggagctcataacccctactccacagctgtgagtacctcaggatgtggagagcatcttgtgcgcaccatactggctagagaatgttcacatgctttacaagctgaggatgctcaccaagccctgttggagactatgcaaaacaagtttatcagttcacctttccttgccagtgaagatggcgtgcttggcggagtgattgtcctccgttcatgcagatgttctgccgagcctgactcctcccaaaataagcagacacttctagtggaatttctgtggagccacacgacggagagcatgtgtgtcggatatatgtcagcccaggatgggaaagccaagactcacatttcaagacttcctcctggtgcggtggcaggacagtctgtggcaatcgaaggtggggtgtgccgcctggagagcccagtgaactgacccttcaggctgagtgtgaagcgtctcagaggcatttcagaacctgagcttttgggggtttttaactgaagttggttgttttatctttcttgttttataattcctattgcaacctcgtgcactgctcgagacacaagtgctgctgtagttagcgcttagtgacacgcgggcctttggtgggtgagcgggactgtgtgtgagtgtgtgcgcgtatgtgcgcacatatgtgtatgtgtggagtatgtgtgtttgcttctccgtggatgaaatagaaactcctcattgtgtgaccaggaatggttaaatcatctttacaaaatgtgtgctttaactgtttacaagtaaaacctaaagttgcaggaaacattttttatttcgtaaagaggtaccaactgtcgctgatgtgatatgtcagaactgaagagtaaatctacttgtttaaatgacttgacagtggtagtgctccatttaataacagtaataagtaataaagtgtttttatttgttaaccagtttaagtggatcctgtggtaacttaaactgttgttctcatcccttatatggggcatttttctttaacaaagaatggtttcagtgaaacaatctagcagagaattaatgtcagaacctttttaaataatagtctgattgatacagtttgtacttatttcatcaagcttttctaagcttaaatattgcatagcttcgagctgtatggactatattatgaaagaatatgtaaagagaacatacagtaatgcacagtccttaatttgtgtataatggaaagttatttacaatataacactgtaaataagaaagcaaagtttatgggaaaattcaatattatctttgtttttgtttaaatatatttttaagataaaggcacaaaaataaaagaagcgtattactgggtatagtatgtgactcctcttctcagactaataaattatcttttgaatccttgg

SEQ ID NO: 189251 - DNA, 426 bp, Homo sapiens
  Payload ID: 17361
  Gene Symbol: TASP1
  Gene Name: taspase, threonine aspartase, 1
  ENST ID: ENST00000434275
  CDS Start-End: 1-332
gtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggcaattgaaaagctgcaggccggtgctcttgcaactgacgcagtcactgcagcactggtggaacttgagctcatgtggaaaggacaatttcaggtactgtgtgtgctaactaacctcttcctggacatcataaagaatccaactaaaacaaagtttaaaactatttcaaatgtgaaagtttattgaagccaatattctattttagagatttgtgttatgtttttgacaagtaactgtactgtaattatgtggctttcaattaaaaaatgtgaaaactgtt

SEQ ID NO: 189252 - DNA, 1000 bp, Homo sapiens
  Payload ID: 17361
  Gene Symbol: TASP1
  Gene Name: taspase, threonine aspartase, 1
  ENST ID: ENST00000455532
  CDS Start-End: 85-1000
gctgaagcggggtaattcctctcctgcaattacttttggatggaagtatgcccctttctcagtagaagatggtaatcttggagaatgaccatggagaaggggatgagttctggagaagggctgccttccagatcatctcaggtttcggctggtaaaataacagccaaagagttggaaacaaagcagtcctataaagagaaacgaggaggctttgtgttggtgcatgcaggtgcaggttatcattctgaatccaaagccaaggagtataaacatgtatgcaaacgagcttgtcagaaggattctccttttacaaatgcaggaatgggatctaatctaaatctgttaggtgaaattgagtgtgatgccagcataatggatggaaaatccttaaattttggagcagttggagcactgagtggaatcaagaacccagtctcggttgccaacagactcttatgtgaagggcagaagggcaagctctcggctggcagaattcctccctgctttttagttggagaaggagcctacagatgggcagtagatcatggaataccctcttgccctcctaacatcatgaccacaagattcagtttagctgcatttaaaagaaacaagaggaaactagagctggcagaaagggtggacacagattttatgcaactaaagaaaagaagacaatcaagtgagaaggaaaatgactcaggcactttggacacggtaggcgctgtggttgtggaccacgaagggaatgttgctgctgctgtctccagtggaggcttggccttgaaacatccggggagagttgggcaggctgctctttatggatgtggctgctgggctgaaaatactggagctcataacccctactccacagctgtgagtacctcaggatgtggagagcatcttgtgcgcaccatactggctagagaatgttcacatgctttacaagctgaggatgctcaccaagccctgttggagactatgcaaaacaagtttatca

SEQ ID NO: 189253 - DNA, 1871 bp, Homo sapiens
  Payload ID: 17362
  Gene Symbol: TAS1R1
  Gene Name: taste receptor, type 1, member 1
  Uniprot ID: Q7RTX1
  ENST ID: ENST00000351136
  CDS Start-End: 66-1829
atttaagcaactggcctccttagaggccactccttggccatgccaggcgcgggcatctggccagcatgctgctctgcacggctcgcctggtcggcctgcagcttctcatttcctgctgctgggcctttgcctgccatagcacggagtcttctcctgacttcaccctccccggagattacctcctggcaggcctgttccctctccattctggctgtctgcaggtgaggcacagacccgaggtgaccctgtgtgacaggtcttgtagcttcaatgagcatggctaccacctcttccaggctatgcggcttggggttgaggagataaacaactccacggccctgctgcccaacatcaccctggggtaccagctgtatgatgtgtgttctgactctgccaatgtgtatgccacgctgagagtgctctccctgccagggcaacaccacatagagctccaaggagaccttctccactattcccctacggtgctggcagtgattgggcctgacagcaccaaccgtgctgccaccacagccgccctgctgagccctttcctggtgcccatgcttttggagcagatccacaaggtgcatttccttctacacaaggacactgtggcgtttaatgacaacagagatcccctcagtagctataacataattgcctgggactggaatggacccaagtggaccttcacggtcctcggttcctccacatggtctccagttcagctaaacataaatgagaccaaaatccagtggcacggaaaggacaaccaggtgcctaagtctgtgtgttccagcgactgtcttgaagggcaccagcgagtggttacgggtttccatcactgctgctttgagtgtgtgccctgtggggctgggaccttcctcaacaagagtgacctctacagatgccagccttgtgggaaagaagagtgggcacctgagggaagccagacctgcttcccgcgcactgtggtgtttttggctttgcgtgagcacacctcttgggtgctgctggcagctaacacgctgctgctgctgctgctgcttgggactgctggcctgtttgcctggcacctagacacccctgtggtgaggtcagcagggggccgcctgtgctttcttatgctgggctccctggcagcaggtagtggcagcctctatggcttctttggggaacccacaaggcctgcgtgcttgctacgccaggccctctttgcccttggtttcaccatcttcctgtcctgcctgacagttcgctcattccaactaatcatcatcttcaagttttccaccaaggtacctacattctaccacgcctgggtccaaaaccacggtgctggcctgtttgtgatgatcagctcagcggcccagctgcttatctgtctaacttggctggtggtgtggaccccactgcctgctagggaataccagcgcttcccccatctggtgatgcttgagtgcacagagaccaactccctgggcttcatactggccttcctctacaatggcctcctctccatcagtgcctttgcctgcagctacctgggtaaggacttgccagagaactacaacgaggccaaatgtgtcaccttcagcctgctcttcaacttcgtgtcctggatcgccttcttcaccacggccagcgtctacgacggcaagtacctgcctgcggccaacatgatggctgggctgagcagcctgagcagcggcttcggtgggtattttctgcctaagtgctacgtgatcctctgccgcccagacctcaacagcacagagcacttccaggcctccattcaggactacacgaggcgctgcggctccacctgaccagtgggtcagcaggcacggctggcagccttctctgccctg

SEQ ID NO: 189254 - DNA, 1810 bp, Homo sapiens
  Payload ID: 17362
  Gene Symbol: TAS1R1
  Gene Name: taste receptor, type 1, member 1
  ENST ID: ENST00000328191
  CDS Start-End: 12-926
tcttccaggctatgcggcttggggttgaggagataaacaactccacggccctgctgcccaacatcaccctggggtaccagctgtatgatgtgtgttctgactctgccaatgtgtatgccacgctgagagtgctctccctgccagggcaacaccacatagagctccaaggagaccttctccactattcccctacggtgctggcagtgattgggcctgacagcaccaaccgtgctgccaccacagccgccctgctgagccctttcctggtgcccatgattagctatgcggccagcagcgagacgctcagcgtgaagcggcagtatccctctttcctgcgcaccatccccaatgacaagtaccaggtggagaccatggtgctgctgctgcagaagttcgggtggacctggatctctctggttggcagcagtgacgactatgggcagctaggggtgcaggcactggagaaccaggccactggtcaggggatctgcattgctttcaaggacatcatgcccttctctgcccaggtgggcgatgagaggatgcagtgcctcatgcgccacctggcccaggccggggccaccgtcgtggttgttttttccagccggcagttggccagggtgtttttcgagtccgtggtgctgaccaacctgactggcaaggtgtgggtcgcctcagaagcctgggccctctccaggcacatcactggggtgcccgggatccagcgcattgggatggtgctgggcgtggccatccagaagagggctgtccctggcctgaaggcgtttgaagaacctatgcccgggcagacaagaaggcccctaggccttgccacaagggctcctggtgcagcagcaatcagctctgcagagaatgccaagctttcatggcacacacgatgcccaagctcaaagccttctccatgagttctgcctacaacgcataccgggctgtgtatgcggtggcccatggcctccaccagctcctgggctgtgcctctggagcttgttccaggggccgagtctacccctggcagacctctacagatgccagccttgtgggaaagaagagtgggcacctgagggaagccagacctgcttcccgcgcactgtggtgtttttggctttgcgtgagcacacctcttgggtgctgctggcagctaacacgctgctgctgctgctgctgcttgggactgctggcctgtttgcctggcacctagacacccctgtggtgaggtcagcagggggccgcctgtgctttcttatgctgggctccctggcagcaggtagtggcagcctctatggcttctttggggaacccacaaggcctgcgtgcttgctacgccaggccctctttgcccttggtttcaccatcttcctgtcctgcctgacagttcgctcattccaactaatcatcatcttcaagttttccaccaaggtacctacattctaccacgcctgggtccaaaaccacggtgctggcctgtttgtgatgatcagctcagcggcccagctgcttatctgtctaacttggctggtggtgtggaccccactgcctgctagggaataccagcgcttcccccatctggtgatgcttgagtgcacagagaccaactccctgggcttcatactggccttcctctacaatggcctcctctccatcagtgcctttgcctgcagctacctgggtaaggacttgccagagaactacaacgaggccaaatgtgtcaccttcagcctgctcttcaacttcgtgtcctggatcgccttcttcaccacggccagcgtctacgacggcaagtacctgcctg

SEQ ID NO: 189255 - DNA, 2892 bp, Homo sapiens
  Payload ID: 17362
  Gene Symbol: TAS1R1
  Gene Name: taste receptor, type 1, member 1
  Uniprot ID: Q7RTX1
  ENST ID: ENST00000333172
  CDS Start-End: 194-2719
cctgcccagttcctgagtgggaccgcaggcccggaatgtcaaggcaaacagtcctgcttcagccactgggctccagtcccaccccttttgggggcctgaagttaggaagcatccggcagctgccttctatttaagcaactggcctccttagaggccactccttggccatgccaggcgcgggcatctggccagcatgctgctctgcacggctcgcctggtcggcctgcagcttctcatttcctgctgctgggcctttgcctgccatagcacggagtcttctcctgacttcaccctccccggagattacctcctggcaggcctgttccctctccattctggctgtctgcaggtgaggcacagacccgaggtgaccctgtgtgacaggtcttgtagcttcaatgagcatggctaccacctcttccaggctatgcggcttggggttgaggagataaacaactccacggccctgctgcccaacatcaccctggggtaccagctgtatgatgtgtgttctgactctgccaatgtgtatgccacgctgagagtgctctccctgccagggcaacaccacatagagctccaaggagaccttctccactattcccctacggtgctggcagtgattgggcctgacagcaccaaccgtgctgccaccacagccgccctgctgagccctttcctggtgcccatgattagctatgcggccagcagcgagacgctcagcgtgaagcggcagtatccctctttcctgcgcaccatccccaatgacaagtaccaggtggagaccatggtgctgctgctgcagaagttcgggtggacctggatctctctggttggcagcagtgacgactatgggcagctaggggtgcaggcactggagaaccaggccactggtcaggggatctgcattgctttcaaggacatcatgcccttctctgcccaggtgggcgatgagaggatgcagtgcctcatgcgccacctggcccaggccggggccaccgtcgtggttgttttttccagccggcagttggccagggtgtttttcgagtccgtggtgctgaccaacctgactggcaaggtgtgggtcgcctcagaagcctgggccctctccaggcacatcactggggtgcccgggatccagcgcattgggatggtgctgggcgtggccatccagaagagggctgtccctggcctgaaggcgtttgaagaagcctatgcccgggcagacaagaaggcccctaggccttgccacaagggctcctggtgcagcagcaatcagctctgcagagaatgccaagctttcatggcacacacgatgcccaagctcaaagccttctccatgagttctgcctacaacgcataccgggctgtgtatgcggtggcccatggcctccaccagctcctgggctgtgcctctggagcttgttccaggggccgagtctacccctggcagcttttggagcagatccacaaggtgcatttccttctacacaaggacactgtggcgtttaatgacaacagagatcccctcagtagctataacataattgcctgggactggaatggacccaagtggaccttcacggtcctcggttcctccacatggtctccagttcagctaaacataaatgagaccaaaatccagtggcacggaaaggacaaccaggtgcctaagtctgtgtgttccagcgactgtcttgaagggcaccagcgagtggttacgggtttccatcactgctgctttgagtgtgtgccctgtggggctgggaccttcctcaacaagagtgacctctacagatgccagccttgtgggaaagaagagtgggcacctgagggaagccagacctgcttcccgcgcactgtggtgtttttggctttgcgtgagcacacctcttgggtgctgctggcagctaacacgctgctgctgctgctgctgcttgggactgctggcctgtttgcctggcacctagacacccctgtggtgaggtcagcagggggccgcctgtgctttcttatgctgggctccctggcagcaggtagtggcagcctctatggcttctttggggaacccacaaggcctgcgtgcttgctacgccaggccctctttgcccttggtttcaccatcttcctgtcctgcctgacagttcgctcattccaactaatcatcatcttcaagttttccaccaaggtacctacattctaccacgcctgggtccaaaaccacggtgctggcctgtttgtgatgatcagctcagcggcccagctgcttatctgtctaacttggctggtggtgtggaccccactgcctgctagggaataccagcgcttcccccatctggtgatgcttgagtgcacagagaccaactccctgggcttcatactggccttcctctacaatggcctcctctccatcagtgcctttgcctgcagctacctgggtaaggacttgccagagaactacaacgaggccaaatgtgtcaccttcagcctgctcttcaacttcgtgtcctggatcgccttcttcaccacggccagcgtctacgacggcaagtacctgcctgcggccaacatgatggctgggctgagcagcctgagcagcggcttcggtgggtattttctgcctaagtgctacgtgatcctctgccgcccagacctcaacagcacagagcacttccaggcctccattcaggactacacgaggcgctgcggctccacctgaccagtgggtcagcaggcacggctggcagccttctctgccctgagggtcgaaggtcgagcaggccgggggtgtccgggaggtctttgggcatcgcggtctggggttgggacgtgtaagcgcctgggagagcctagaccaggctccgggctgccaataaagaagtgaaatgcgta

SEQ ID NO: 189256 - DNA, 740 bp, Homo sapiens
  Payload ID: 17362
  Gene Symbol: TAS1R1
  Gene Name: taste receptor, type 1, member 1
  ENST ID: ENST00000415267
  CDS Start-End: 1-740
tcttccaggctatgcggcttggggttgaggagataaacaactccacggccctgctgcccaacatcaccctggggtaccagctgtatgatgtgtgttctgactctgccaatgtgtatgccacgctgagagtgctctccctgccagggcaacaccacatagagctccaaggagaccttctccactattcccctacggtgctggcagtgattgggcctgacagcaccaaccgtgctgccaccacagccgccctgctgagccctttcctggtgcccatgcttttggagcagatccacaaggtgcatttccttctacacaaggacactgtggcgtttaatgacaacagagatcccctcagtagctataacataattgcctgggactggaatggacccaagtggaccttcacggtcctcggttcctccacatggtctccagttcagctaaacataaatgagaccaaaatccagtggcacggaaaggacaaccaggtgcctaagtctgtgtgttccagcgactgtcttgaagggcaccagcgagtggttacgggtttccatcactgctgctttgagtgtgtgccctgtggggctgggaccttcctcaacaagagtgctacctgggtaaggacttgccagagaactacaacgaggccaaatgtgtcaccttcagcctgctcttcaacttcgtgtcctggatcgccttcttcaccacggccagcgtctacgacggcaagtacctgcctg

SEQ ID NO: 189257 - DNA, 1811 bp, Homo sapiens
  Payload ID: 17362
  Gene Symbol: TAS1R1
  Gene Name: taste receptor, type 1, member 1
  ENST ID: ENST00000411823
  CDS Start-End: 1-1220
tcttccaggctatgcggcttggggttgaggagataaacaactccacggccctgctgcccaacatcaccctggggtaccagctgtatgatgtgtgttctgactctgccaatgtgtatgccacgctgagagtgctctccctgccagggcaacaccacatagagctccaaggagaccttctccactattcccctacggtgctggcagtgattgggcctgacagcaccaaccgtgctgccaccacagccgccctgctgagccctttcctggtgcccatgattagctatgcggccagcagcgagacgctcagcgtgaagcggcagtatccctctttcctgcgcaccatccccaatgacaagtaccaggtggagaccatggtgctgctgctgcagaagttcgggtggacctggatctctctggttggcagcagtgacgactatgggcagctaggggtgcaggcactggagaaccaggccactggtcaggggatctgcattgctttcaaggacatcatgcccttctctgcccaggtgggcgatgagaggatgcagtgcctcatgcgccacctggcccaggccggggccaccgtcgtggttgttttttccagccggcagttggccagggtgtttttcgagtccgtggtgctgaccaacctgactggcaaggtgtgggtcgcctcagaagcctgggccctctccaggcacatcactggggtgcccgggatccagcgcattgggatggtgctgggcgtggccatccagaagagggctgtccctggcctgaaggcgtttgaagaagcctatgcccgggcagacaagaaggcccctaggccttgccacaagggctcctggtgcagcagcaatcagctctgcagagaatgccaagctttcatggcacacacgatgcccaagctcaaagccttctccatgagttctgcctacaacgcataccgggctgtgtatgcggtggcccatggcctccaccagctcctgggctgtgcctctggagcttgttccaggggccgagtctacccctggcagacctctacagatgccagccttgtgggaaagaagagtgggcacctgagggaagccagacctgcttcccgcgcactgtggtgtttttggctttgcgtgagcacacctcttgggtgctgctggcagctaacacgctgctgctgctgctgctgcttgggactgctggcctgtttgcctggcacctagacacccctgtggtgaggtcagcagggggccgcctgtgctttcttatgctgggctccctggcagcaggtagtggcagcctctatggcttctttggggaacccacaaggcctgcgtgcttgctacgccaggccctctttgcccttggtttcaccatcttcctgtcctgcctgacagttcgctcattccaactaatcatcatcttcaagttttccaccaaggtacctacattctaccacgcctgggtccaaaaccacggtgctggcctgtttgtgatgatcagctcagcggcccagctgcttatctgtctaacttggctggtggtgtggaccccactgcctgctagggaataccagcgcttcccccatctggtgatgcttgagtgcacagagaccaactccctgggcttcatactggccttcctctacaatggcctcctctccatcagtgcctttgcctgcagctacctgggtaaggacttgccagagaactacaacgaggccaaatgtgtcaccttcagcctgctcttcaacttcgtgtcctggatcgccttcttcaccacggccagcgtctacgacggcaagtacctgcctg

SEQ ID NO: 189258 - DNA, 2542 bp, Homo sapiens
  Payload ID: 17363
  Gene Symbol: TAS1R2
  Gene Name: taste receptor, type 1, member 2
  Uniprot ID: Q8TE23
  ENST ID: ENST00000375371
  CDS Start-End: 23-2542
ctgagaccatcacttcccagccatggggcccagggcaaagaccatctcctccctgttcttcctcctatgggtcctggctgagccggctgagaactcggacttctacctgcctggggattacctcctgggtggcctcttctccctccatgccaacatgaagggcattgttcaccttaacttcctgcaggtgcccatgtgcaaggagtatgaagtgaaggtgataggctacaacctcatgcaggccatgcgctttgcggtggaggagatcaacaatgacagcagcctgctgcctggtgtgctgctgggctatgagatcgtggatgtgtgctacatctccaacaatgtccagccggtgctctacttcctggcacacgaggacaacctccttcccatccaagaggactacagtaactacatttcccgtgtggtggctgtcattggccctgacaactccgagtctgtcatgactgtggccaacttcctctccctatttctccttccacagatcacctacagcgccatcagcgatgagctgcgagacaaggtgcgcttcccggctttgctgcgtaccacacccagcgccgaccaccacatcgaggccatggtgcagctgatgctgcacttccgctggaactggatcattgtgctggtgagcagcgacacctatggccgcgacaatggccagctgcttggcgagcgcgtggcccggcgcgacatctgcatcgccttccaggagacgctgcccacactgcagcccaaccagaacatgacgtcagaggagcgccagcgcctggtgaccattgtggacaagctgcagcagagcacagcgcgcgtcgtggtcgtgttctcgcccgacctgaccctgtaccacttcttcaatgaggtgctgcgccagaacttcactggcgccgtgtggatcgcctccgagtcctgggccatcgacccggtcctgcacaacctcacggagctgcgccacttgggcaccttcctgggcatcaccatccagagcgtgcccatcccgggcttcagtgagttccgcgagtggggcccacaggctgggccgccacccctcagcaggaccagccagagctatacctgcaaccaggagtgcgacaactgcctgaacgccaccttgtccttcaacaccattctcaggctctctggggagcgtgtcgtctacagcgtgtactctgcggtctatgctgtggcccatgccctgcacagcctcctcggctgtgacaaaagcacctgcaccaagagggtggtctacccctggcagctgcttgaggagatctggaaggtcaacttcactctcctggaccaccaaatcttcttcgacccgcaaggggacgtggctctgcacttggagattgtccagtggcaatgggaccggagccagaatcccttccagagcgtcgcctcctactaccccctgcagcgacagctgaagaacatccaagacatctcctggcacaccatcaacaacacgatccctatgtccatgtgttccaagaggtgccagtcagggcaaaagaagaagcctgtgggcatccacgtctgctgcttcgagtgcatcgactgccttcccggcaccttcctcaaccacactgaagatgaatatgaatgccaggcctgcccgaataacgagtggtcctaccagagtgagacctcctgcttcaagcggcagctggtcttcctggaatggcatgaggcacccaccatcgctgtggccctgctggccgccctgggcttcctcagcaccctggccatcctggtgatattctggaggcacttccagacacccatagttcgctcggctgggggccccatgtgcttcctgatgctgacactgctgctggtggcatacatggtggtcccggtgtacgtggggccgcccaaggtctccacctgcctctgccgccaggccctctttcccctctgcttcacaatctgcatctcctgtatcgccgtgcgttctttccagatcgtctgcgccttcaagatggccagccgcttcccacgcgcctacagctactgggtccgctaccaggggccctacgtctctatggcatttatcacggtactcaaaatggtcattgtggtaattggcatgctggccacgggcctcagtcccaccacccgtactgaccccgatgaccccaagatcacaattgtctcctgtaaccccaactaccgcaacagcctgctgttcaacaccagcctggacctgctgctctcagtggtgggtttcagcttcgcctacatgggcaaagagctgcccaccaactacaacgaggccaagttcatcaccctcagcatgaccttctatttcacctcatccgtctccctctgcaccttcatgtctgcctacagcggggtgctggtcaccatcgtggacctcttggtcactgtgctcaacctcctggccatcagcctgggctacttcggccccaagtgctacatgatcctcttctacccggagcgcaacacgcccgcctacttcaacagcatgatccagggctacaccatgaggagggactag

SEQ ID NO: 189259 - DNA, 3433 bp, Homo sapiens
  Payload ID: 17364
  Gene Symbol: TAS1R3
  Gene Name: taste receptor, type 1, member 3
  Uniprot ID: Q7RTX0
  ENST ID: ENST00000339381
  CDS Start-End: 33-2591
acctgccgtgcctgttggaagttgcctctgccatgctgggccctgctgtcctgggcctcagcctctgggctctcctgcaccctgggacgggggccccattgtgcctgtcacagcaacttaggatgaagggggactacgtgctgggggggctgttccccctgggcgaggccgaggaggctggcctccgcagccggacacggcccagcagccctgtgtgcaccaggttctcctcaaacggcctgctctgggcactggccatgaaaatggccgtggaggagatcaacaacaagtcggatctgctgcccgggctgcgcctgggctacgacctctttgatacgtgctcggagcctgtggtggccatgaagcccagcctcatgttcctggccaaggcaggcagccgcgacatcgccgcctactgcaactacacgcagtaccagccccgtgtgctggctgtcatcgggccccactcgtcagagctcgccatggtcaccggcaagttcttcagcttcttcctcatgccccaggtcagctacggtgctagcatggagctgctgagcgcccgggagaccttcccctccttcttccgcaccgtgcccagcgaccgtgtgcagctgacggccgccgcggagctgctgcaggagttcggctggaactgggtggccgccctgggcagcgacgacgagtacggccggcagggcctgagcatcttctcggccctggccgcggcacgcggcatctgcatcgcgcacgagggcctggtgccgctgccccgtgccgatgactcgcggctggggaaggtgcaggacgtcctgcaccaggtgaaccagagcagcgtgcaggtggtgctgctgttcgcctccgtgcacgccgcccacgccctcttcaactacagcatcagcagcaggctctcgcccaaggtgtgggtggccagcgaggcctggctgacctctgacctggtcatggggctgcccggcatggcccagatgggcacggtgcttggcttcctccagaggggtgcccagctgcacgagttcccccagtacgtgaagacgcacctggccctggccaccgacccggccttctgctctgccctgggcgagagggagcagggtctggaggaggacgtggtgggccagcgctgcccgcagtgtgactgcatcacgctgcagaacgtgagcgcagggctaaatcaccaccagacgttctctgtctacgcagctgtgtatagcgtggcccaggccctgcacaacactcttcagtgcaacgcctcaggctgccccgcgcaggaccccgtgaagccctggcagctcctggagaacatgtacaacctgaccttccacgtgggcgggctgccgctgcggttcgacagcagcggaaacgtggacatggagtacgacctgaagctgtgggtgtggcagggctcagtgcccaggctccacgacgtgggcaggttcaacggcagcctcaggacagagcgcctgaagatccgctggcacacgtctgacaaccagaagcccgtgtcccggtgctcgcggcagtgccaggagggccaggtgcgccgggtcaaggggttccactcctgctgctacgactgtgtggactgcgaggcgggcagctaccggcaaaacccagacgacatcgcctgcaccttttgtggccaggatgagtggtccccggagcgaagcacacgctgcttccgccgcaggtctcggttcctggcatggggcgagccggctgtgctgctgctgctcctgctgctgagcctggcgctgggccttgtgctggctgctttggggctgttcgttcaccatcgggacagcccactggttcaggcctcgggggggcccctggcctgctttggcctggtgtgcctgggcctggtctgcctcagcgtcctcctgttccctggccagcccagccctgcccgatgcctggcccagcagcccttgtcccacctcccgctcacgggctgcctgagcacactcttcctgcaggcggccgagatcttcgtggagtcagaactgcctctgagctgggcagaccggctgagtggctgcctgcgggggccctgggcctggctggtggtgctgctggccatgctggtggaggtcgcactgtgcacctggtacctggtggccttcccgccggaggtggtgacggactggcacatgctgcccacggaggcgctggtgcactgccgcacacgctcctgggtcagcttcggcctagcgcacgccaccaatgccacgctggcctttctctgcttcctgggcactttcctggtgcggagccagccgggctgctacaaccgtgcccgtggcctcacctttgccatgctggcctacttcatcacctgggtctcctttgtgcccctcctggccaatgtgcaggtggtcctcaggcccgccgtgcagatgggcgccctcctgctctgtgtcctgggcatcctggctgccttccacctgcccaggtgttacctgctcatgcggcagccagggctcaacacccccgagttcttcctgggagggggccctggggatgcccaaggccagaatgacgggaacacaggaaatcaggggaaacatgagtgacccaaccctgtgatctcagccccggtgaacccagacttagctgcgatcccccccaagccagcaatgacccgtgtctcgctacagagaccctcccgctctaggttctgaccccaggttgtctcctgaccctgaccccacagtgagccctaggcctggagcacgtggacacccctgtgaccatctgggccccagagccaagctgtgtccctgtccctctgtgcccagaccaggcctgcccaggtaacccagacccactgttctggaaagaggcccggagggctcccagggtacccgcaacccacaccgtgagctcaggaaaaggacgcagggaggccccggccagatggctggaagcccaaatcaggccctgccgacctgaccatgtcccaccagggcccccatcctgcaccctgccaggcaccacagcagtgggaggccaggtgggggcacacaggcatatgcccagggcagagcccgccgaggtaggggtggcacccagcttcctactctgccctttgcccagtgggtagacagcatcatgactgtcaccagtaccagggacagagcccaggtggggtgggggcggggtccagcaccacggccagcaccgaccaccaggaccccggagccagcaccatggacagaaaactgcccaccaggatctgacgccagcacgccgccaggcccacacagggtctccggtcagagtcccagggtcagctcccagcagggcctaggggaggctggaccagctccctgtgcctcattccaaggcagcccagccggagagaaggggcacaggccacacatctgtcccataaaattaaacgctttttagtgtt

SEQ ID NO: 189260 - DNA, 1359 bp, Homo sapiens
  Payload ID: 17365
  Gene Symbol: TAS2R1
  Gene Name: taste receptor, type 2, member 1
  Uniprot ID: Q9NYW7
  ENST ID: ENST00000382492
  CDS Start-End: 324-1223
gctgttctcccagctgtctgaaggtgtctgattccattatttgcctgtgatgactttgaaagctaggtaaacctgtaaaatgcaaaagccatcaataagaagcaaattgatgctagagtatctcctccttatttgactgtctcagaactaaatagagaaagcagtgacataaacaaatgtacaccaccttcctgccccatgcctttattgttagtcttcttccccagaggagtcctgatctaattgaagagcgtgaacaacccaacctgtccaaaactttataacttcattattttttaagtaaataattttttattcctaaaatgctagagtctcacctcattatctattttcttcttgcagtgatacaatttcttcttgggattttcacaaatggcatcattgtggtggtgaatggcattgacttgatcaagcacagaaaaatggctccgctggatctccttctttcttgtctggcagtttctagaatttttctgcagttgttcatcttctacgttaatgtgattgttatcttcttcatagaattcatcatgtgttctgcgaattgtgcaattctcttatttataaatgaattggaactttggcttgccacatggctcggcgttttctattgtgccaaggttgccagcgtccgtcacccactcttcatctggttgaagatgaggatatccaagctggtcccatggatgatcctggggtctctgctatatgtatctatgatttgtgttttccatagcaaatatgcagggtttatggtcccatacttcctaaggaaatttttctcccaaaatgccacaattcaaaaagaagatacactggctatacagattttctcttttgttgctgagttctcagtgccattgcttatcttcctttttgctgttttgctcttgattttctctctggggaggcacacccggcaaatgagaaacacagtggccggcagcagggttcctggcaggggtgcacccatcagcgcgttgctgtctatcctgtccttcctgatcctctacttctcccactgcatgataaaagtttttctctcttctctaaagtttcacatcagaaggttcatctttctgttcttcatccttgtgattggtatatacccttctggacactctctcatcttaattttaggaaatcctaaattgaaacaaaatgcaaaaaagttcctcctccacagtaagtgctgtcagtgagagagaagttggatcagttcaaagaacccatgattcaatgatttacccatgcctgccacacttccctcagccagacaaagcagcctgttcataaatatacaacatgtccccttcaggcctgtttatccagcctgag

SEQ ID NO: 189261 - DNA, 454 bp, Homo sapiens
  Payload ID: 17365
  Gene Symbol: TAS2R1
  Gene Name: taste receptor, type 2, member 1
  ENST ID: ENST00000506620
  CDS Start-End: 271-454
aaacactgatgcctaaagggaccaggcagtagacctgactggggagctaagtgatctcgtgtgactctctatgcctcgttgccaccagcgtgggccatctccaggggctctcaaaccgatagaagaccttgcggtgtgggaaaacagctccagagcttctaagctgagcggattgttcctagtgaggaagtgatacaatttcttcttgggattttcacaaatggcatcattgtggtggtgaatggcattgacttgatcaagcacagaaaaatggctccgctggatctccttctttcttgtctggcagtttctagaatttttctgcagttgttcatcttctacgttaatgtgattgttatcttcttcatagaattcatcatgtgttctgcgaattgtgcaattctcttatttataaatgaattggaactttggcttgccacatggctcggcgttt

SEQ ID NO: 189262 - DNA, 754 bp, Homo sapiens
  Payload ID: 17365
  Gene Symbol: TAS2R1
  Gene Name: taste receptor, type 2, member 1
  ENST ID: ENST00000514078
  CDS Start-End: 288-754
ggtgtttgaccaaactactgggcaccataccccagccaagtcagcatataatgtgaaccatcacagtgggagacatgtcacaaagtggtaagacagcaagaattggtggtctgggctggattccagagaacctggactgtgcctatgaagcaccactgccctgtagacctgggataataaacactgatgcctaaagggaccaggcagtgatacaatttcttcttgggattttcacaaatggcatcattgtggtggtgaatggcattgacttgatcaagcacagaaaaatggctccgctggatctccttctttcttgtctggcagtttctagaatttttctgcagttgttcatcttctacgttaatgtgattgttatcttcttcatagaattcatcatgtgttctgcgaattgtgcaattctcttatttataaatgaattggaactttggcttgccacatggctcggcgttttctattgtgccaaggttgccagcgtccgtcacccactcttcatctggttgaagatgaggatatccaagctggtcccatggatgatcctggggtctctgctatatgtatctatgatttgtgttttccatagcaaatatgcagggtttatggtcccatacttcctaaggaaatttttctcccaaaatgccacaattcaaaaagaagatacactggctatacagattttctcttttgttgctgagttctcagtgccattgcttatcttcctttttgctgttttgct

SEQ ID NO: 189263 - DNA, 1042 bp, Homo sapiens
  Payload ID: 17366
  Gene Symbol: TAS2R10
  Gene Name: taste receptor, type 2, member 10
  Uniprot ID: Q9NYW0
  ENST ID: ENST00000240619
  CDS Start-End: 90-1013
cacttccgtcgagcagccaatatatgcctcattctgcagcaggtaatctaagatagatgtaacagaagcaatattaagaattagcagatatgctacgtgtagtggaaggcatcttcatttttgttgtagttagtgagtcagtgtttggggttttggggaatggatttattggacttgtaaactgcattgactgtgccaagaataagttatctacgattggctttattctcaccggcttagctatttcaagaatttttctgatatggataataattacagatggatttatacagatattctctccaaatatatatgcctccggtaacctaattgaatatattagttacttttgggtaattggtaatcaatcaagtatgtggtttgccaccagcctcagcatcttctatttcctgaagatagcaaatttttccaactacatatttctctggttgaagagcagaacaaatatggttcttcccttcatgatagtattcttacttatttcatcgttacttaattttgcatacattgcgaagattcttaatgattataaaacgaagaatgacacagtctgggatctcaacatgtataaaagtgaatactttattaaacagattttgctaaatctgggagtcattttcttctttacactatccctaattacatgtatttttttaatcatttccctttggagacacaacaggcagatgcaatcgaatgtgacaggattgagagactccaacacagaagctcatgtgaaggcaatgaaagttttgatatctttcatcatcctctttatcttgtattttataggcatggccatagaaatatcatgttttactgtgcgagaaaacaaactgctgcttatgtttggaatgacaaccacagccatctatccctggggtcactcatttatcttaattctaggaaacagcaagctaaagcaagcctctttgagggtactgcagcaattgaagtgctgtgagaaaaggaaaaatctcagagtcacatagacaccttgggaagagatggatgttccacg

SEQ ID NO: 189264 - DNA, 1042 bp, Homo sapiens; identical to SEQ ID NO: 189263
  Payload ID: 17366
  Gene Symbol: TAS2R10
  Gene Name: taste receptor, type 2, member 10
  Uniprot ID: Q9NYW0
  ENST ID: ENST00000576159
  CDS Start-End: 90-1013

SEQ ID NO: 189265 - DNA, 1042 bp, Homo sapiens; identical to SEQ ID NO: 189263
  Payload ID: 17366
  Gene Symbol: TAS2R10
  Gene Name: taste receptor, type 2, member 10
  Uniprot ID: Q9NYW0
  ENST ID: ENST00000611256
  CDS Start-End: 90-1013

SEQ ID NO: 189266 - DNA, 1637 bp, Homo sapiens
  Payload ID: 17367
  Gene Symbol: TAS2R13
  Gene Name: taste receptor, type 2, member 13
  Uniprot ID: Q9NYV9
  ENST ID: ENST00000390677
  CDS Start-End: 265-1176
tctgcccatggtgaagacataaatatcttagctagggctcagcagagaaattgaagaaaaataaagatatcaccagaacagttatgtgaagatcgatcagcaaactttagagatttctgctttgacgttgagccaacaatgaaagaaggagcagaaaaaggagaaggaagaagaactccactggacactcaaggatgtgaatagcattttagatcagtgaataaccagcagtgacattagacattgaactttctctgttctgacatggaaagtgccctgccgagtatcttcactcttgtaataattgcagaattcataattgggaatttgagcaatggatttatagtactgatcaactgcattgactgggtcagtaaaagagagctgtcctcagtcgataaactcctcattatcttggcaatctccagaattgggctgatctgggaaatattagtaagttggtttttagctctgcattatctagccatatttgtgtctggaacaggattaagaattatgatttttagctggatagtttctaatcacttcaatctctggcttgctacaatcttcagcatcttttatttgctcaaaatagcgagtttctctagccctgcttttctctatttgaagtggagagtaaacaaagtgattctgatgatactgctaggaaccttggtcttcttatttttaaatctgatacaaataaacatgcatataaaagactggctggaccgatatgaaagaaacacaacttggaatttcagtatgagtgactttgaaacattttcagtgtcggtcaaattcactatgactatgttcagtctaacaccatttactgtggccttcatctcttttctcctgttaattttctccctgcagaaacatctccagaaaatgcaactcaattacaaaggacacagagaccccaggaccaaggtccatacaaatgccttgaaaattgtgatctcattccttttattctatgctagtttctttctatgtgttctcatatcatggatttctgagctgtatcagaacacagtgatctacatgctttgtgagacgattggagtcttctctccttcaagccactcctttcttctgattctaggaaacgctaagttaagacaggcctttcttttggtggcagctaaggtatgggctaaacgatgagaaactcacaatttcataagccattcagaccacagattattgaatattgcagacagaaacaggagtctacaaggagtttaaaagatattttatgcttcccctggtttcttttattgtgaaggtcactgtaaatgttttaaattcttctctataatagcatcttacctaagaatattatgtatttatgacatgtatttctacattattaggaatttgaaacttatttgaggaaattattggcagattctattgtaaattaaaaacatatactacagcatacttagatgttaattgtaaatctacaatcttttgtttggcaatggctcttcaattctaaatcattcattgagatgggtgatttaggtaattattttattatctcaagtactcctatttaaatggtgagctacagataattagaacagttatttggaatagaattagggaagtttggacttgcc

SEQ ID NO: 189267 - DNA, 1637 bp, Homo sapiens; identical to SEQ ID NO: 189266
  Payload ID: 17367
  Gene Symbol: TAS2R13
  Gene Name: taste receptor, type 2, member 13
  Uniprot ID: Q9NYV9
  ENST ID: ENST00000574870
  CDS Start-End: 265-1176

SEQ ID NO: 189268 - DNA, 1637 bp, Homo sapiens; identical to SEQ ID NO: 189266
  Payload ID: 17367
  Gene Symbol: TAS2R13
  Gene Name: taste receptor, type 2, member 13
  Uniprot ID: Q9NYV9
  ENST ID: ENST00000613662
  CDS Start-End: 265-1176

SEQ ID NO: 189269 - DNA, 1858 bp, Homo sapiens
  Payload ID: 17368
  Gene Symbol: TAS2R14
  Gene Name: taste receptor, type 2, member 14
  Uniprot ID: Q9NYV8
  ENST ID: ENST00000537503
  CDS Start-End: 57-1010
tgcattaagaagtcttcagcagtgatattagacattggggcatgctcttacaggcaatgggtggtgtcataaagagcatatttacattcgttttaattgtggaatttataattggaaatttaggaaatagtttcatagcactggtgaactgtattgactgggtcaagggaagaaagatctcttcggttgatcggatcctcactgctttggcaatctctcgaattagcctggtttggttaatattcggaagctggtgtgtgtctgtgtttttcccagctttatttgccactgaaaaaatgttcagaatgcttactaatatctggacagtgatcaatcattttagtgtctggttagctacaggcctcggtactttttattttctcaagatagccaatttttctaactctatttttctctacctaaagtggagggttaaaaaggtggttttggtgctgcttcttgtgacttcggtcttcttgtttttaaatattgcactgataaacatccatataaatgccagtatcaatggatacagaagaaacaagacttgcagttctgattcaagtaactttacacgattttccagtcttattgtattaaccagcactgtgttcattttcataccctttactttgtccctggcaatgtttcttctcctcatcttctccatgtggaaacatcgcaagaagatgcagcacactgtcaaaatatccggagacgccagcaccaaagcccacagaggagttaaaagtgtgatcactttcttcctactctatgccattttctctctgtcttttttcatatcagtttggacctctgaaaggttggaggaaaatctaattattctttcccaggtgatgggaatggcttatccttcatgtcactcatgtgttctgattcttggaaacaagaagctgagacaggcctctctgtcagtgctactgtggctgaggtacatgttcaaagatggggagccctcaggtcacaaagaatttagagaatcatcttgaatatattagaaaaaaaatagctcctaagaaattcttgtatgttatataaatttatacttccttaagattctttcattgtgtataactttgtgaattttacaaagatatgcttggaatcaacaccatccaaacatatcacaaattaggatatatgaaagtatgtatattaccatacagagaagaatgcgaatactataaagagttcttatacaaacagataatatagattttgtatcaatcattcaccttttttgagatttttaaatgagaaaacctataatgtataaaatacatgtgtgtatgtatgtatgtgacacagttactaaaaataggcttcttaaacttacatctcaatctggtagataaagtacataaaagaatatggaattttagtacctatattaagtgtttttaatttttgtataatatttagtacctgattagcgtgtatgcaaaaaagtaatttgcttcgtttgttgaattagaagccagctgccttactaaactaccacatttgctttgctcattctcttggctttgcagatagaaaattatatcatctgcatatagtgacttataatgattattttacttctccattttactacttgtaattcttttttggtatcagttgtataatgaaatggtttgaacattcaaagtgttaagtaatcctgatcgtaactgctgtctttgcaaatggagtgttttctagtgttttaacaataaacgtaatactgactctagctttgagataaattcttttaaaaatattcttcagggagaatatttgtttcctatcttcctgtgtatagtattgtaataaaatctctgttaaaaactatcaa

SEQ ID NO: 189270 - DNA, 1858 bp, Homo sapiens; identical to SEQ ID NO: 189269
  Payload ID: 17368
  Gene Symbol: TAS2R14
  Gene Name: taste receptor, type 2, member 14
  Uniprot ID: Q9NYV8
  ENST ID: ENST00000575008
  CDS Start-End: 57-1010

SEQ ID NO: 189271 - DNA, 1859 bp, Homo sapiens
  Payload ID: 17368
  Gene Symbol: TAS2R14
  Gene Name: taste receptor, type 2, member 14
  Uniprot ID: Q9NYV8
  ENST ID: ENST00000614274
  CDS Start-End: 57-1010
tgcattaagaagtcttcagcagtgatattagacattggggcatgctcttacaggcaatgggtggtgtcataaagagcatatttacattcgttttaattgtggaatttataattggaaatttaggaaatagtttcatagcactggtgaactgtattgactgggtcaagggaagaaagatctcttcggttgatcggatcctcactgctttggcaatctctcgaattagcctggtttggttaatattcggaagctggtgtgtgtctgtgtttttcccagctttatttgccactgaaaaaatgttcagaatgcttactaatatctggacagtgatcaatcattttagtgtctggttagctacaggcctcggtactttttattttctcaagatagccaatttttctaactctatttttctctacctaaagtggagggttaaaaaggtggttttggtgctgcttcttgtgacttcggtcttcttgtttttaaatattgcactgataaacatccatataaatgccagtatcaatggatacagaagaaacaagacttgcagttctgattcaagtaactttacacgattttccagtcttattgtattaaccagcactgtgttcattttcataccctttactttgtccctggcaatgtttcttctcctcatcttctccatgtggaaacatcgcaagaagatgcagcacactgtcaaaatatccggagacgccagcaccaaagcccacagaggagttaaaagtgtgatcactttcttcctactctatgccattttctctctgtcttttttcatatcagtttggacctctgaaaggttggaggaaaatctaattattctttcccaggtgatgggaatggcttatccttcatgtcactcatgtgttctgattcttggaaacaagaagctgagacaggcctctctgtcagtgctactgtggctgaggtacatgttcaaagatggggagccctcaggtcacaaagaatttagagaatcatcttgaatatattagaaaaaaaatagctcctaagaaattcttgtatgttatataaatttatacttccttaagattctttcattgtgtataactttgtgaattttacaaagatatgcttggaatcaacaccatccaaacatatcacaaattaggatatatgaaagtatgtatattaccatacagagaagaatgcgaatactataaagagttcttatacaaacagataatatagattttgtatcaatcattcaccttttttgagatttttaaatgagaaaacctataatgtataaaatacatgtgtgtatgtatgtatgtgacacagttactaaaaataggcttcttaaacttacatctcaatctggtagataaagtacataaaagaatatggaattttagtacctatattaagtgtttttaatttttgtataatatttagtacctgattagcgtgtatgcaaaaaagtaatttgcttcgtttgttgaattagaagccagctgccttactaaactaccacatttgctttgctcattctcttggctttgcagatagaaaattatatcatctgcatatagtgacttataatgattattttacttctccattttactacttgtaattcttttttggtatcagttgtataatgaaatggtttgaacattcaaagtgttaagtaatcctgatcgtaactgctgtctttgcaaatggagtgttttctagtgttttaacaataaacgtaatactgactctagctttgagataaattcttttaaaaatattcttcagggagaatatttgtttcctatcttcctgtgtatagtattgtaataaaatctctgttaaaaactatcaaa

SEQ ID NO: 189272 - DNA, 997 bp, Homo sapiens
  Payload ID: 17369
  Gene Symbol: TAS2R16
  Gene Name: taste receptor, type 2, member 16
  Uniprot ID: Q9NYV7
  ENST ID: ENST00000249284
  CDS Start-End: 67-942
tctctacctggaaattggtacagagattcagagtctttgtccaggaagacactttggagtagaagaatgatacccatccaactcactgtcttcttcatgatcatctatgtgcttgagtccttgacaattattgtgcagagcagcctaattgttgcagtgctgggcagagaatggctgcaagtcagaaggctgatgcctgtggacatgattctcatcagcctgggcatctctcgcttctgtctacagtgggcatcaatgctgaacaatttttgctcctattttaatttgaattatgtactttgcaacttaacaatcacctgggaattttttaatatccttacattctggttaaacagcttgcttaccgtgttctactgcatcaaggtctcttctttcacccatcacatctttctctggctgaggtggagaattttgaggttgtttccctggatattactgggttctctgatgattacttgtgtaacaatcatcccttcagctattgggaattacattcaaattcagttactcaccatggagcatctaccaagaaacagcactgtaactgacaaacttgaaaattttcatcagtatcagttccaggctcatacagttgcattggttattcctttcatcctgttcctggcctccaccatctttctcatggcatcactgaccaagcagatacaacatcatagcactggtcactgcaatccaagcatgaaagcgcgcttcactgccctgaggtcccttgccgtcttatttattgtgtttacctcttactttctaaccatactcatcaccattataggtactctatttgataagagatgttggttatgggtctgggaagcttttgtctatgctttcatcttaatgcattccacttcactgatgctgagcagccctacgttgaaaaggattctaaagggaaagtgctaggcctagaggttgcctgaggcacaggataaaagactcccgagcaattgatataatt

SEQ ID NO: 189273 - DNA, 1002 bp, Homo sapiens
  Payload ID: 17370
  Gene Symbol: TAS2R19
  Gene Name: taste receptor, type 2, member 19
  Uniprot ID: P59542
  ENST ID: ENST00000390673
  CDS Start-End: 50-949
ggactcagaacaagtgttactaagcctgcatttttttatctgttcaaacatgatgtgttttctgctcatcatttcatcaattctggtagtgtttgcatttgttcttggaaatgttgccaatggcttcatagccctagtaaatgtcattgactgggttaacacacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcaagattgccaatttctccaaccttatttctctccacctaaagaagagaattaagagtgttgttctggtgatactgttggggcccttggtatttctgatttgtaatcttgctgtgataaccatggatgagagagtgtggacaaaagaatatgaaggaaatgtgacttggaagatcaaattgaggaatgcaatacacctttcaagcttgactgtaactactctagcaaacctcataccctttactctgagcctaatatgttttctgctgttaatctgttctctttgtaaacatctcaagaagatgcggctccatagcaaaggatctcaagatcccagcaccaaggtccatataaaagctttgcaaactgtgacctccttcctcatgttatttgccatttactttctgtgtataatcacatcaacttggaatcttaggacacagcagagcaaacttgtactcctgctttgccaaactgttgcaatcatgtatccttcattccactcattcatcctgattatgggaagtaggaagctaaaacagacctttctttcagttttgtggcagatgacacgctgagtgaaagaagagaaaccctcaactccatagattcacaaggggagcatcgtggg

SEQ ID NO: 189274 - DNA, 1002 bp, Homo sapiens; identical to SEQ ID NO: 189273
  Payload ID: 17370
  Gene Symbol: TAS2R19
  Gene Name: taste receptor, type 2, member 19
  Uniprot ID: P59542
  ENST ID: ENST00000573562
  CDS Start-End: 50-949

SEQ ID NO: 189275 - DNA, 960 bp, Homo sapiens
  Payload ID: 17370
  Gene Symbol: TAS2R19
  Gene Name: taste receptor, type 2, member 19
  ENST ID: ENST00000610376
  CDS Start-End: 1-960
atgatgtgttttctgctcatcatttcatcaattctggtagtgtttgcatttgttcttggaaatgttgccaatggcttcatagctctagtaaatgtcattgactgggttaacacacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcaagattgccaatttctccaaccttatttctctccacctaaagaagagaattaagagtgttgttctggtgatactgttggggcccttggtatttttgatttgtaatcttgctgtgataaccatggatgagagagtgtggacaaaagaatatgaaggaaatgtgacttggaagatcaaattgaggaatgcaatgcacctttccaacttgactgtagccatgctagcaaacttgataccattcactctgaccctgatatcttttctgctgttaatctactctctgtgtaaacatctgaagaagatgcagctccatggcaaaggatctcaagatcccagcaccaagatccacataaaagctctgcaaactgtgacctccttcctcatattacttgccatttactttctgtgtctaatcatatcgttttggaattttaagatgcgaccaaaagaaattgtcttaatgctttgccaagcttttggaatcatatatccatcattccactcattcattctgatttgggggaacaagacgctaaagcagacctttctttcagttttgtggcaggtgacttgctgggcaaaagacagaaccagtcaactccatagattcacaagaggtgcattgtgtgttttctag

SEQ ID NO: 189276 - DNA, 1002 bp, Homo sapiens
  Payload ID: 17370
  Gene Symbol: TAS2R19
  Gene Name: taste receptor, type 2, member 19
  ENST ID: ENST00000631934
  CDS Start-End: 50-949
ggactcagaacaagtgttactaagcctgcatttttttatctgttcaaacatgatgtgttttctgctcatcatttcatcaattctggtagtgtttgcatttgttcttggaaatgttgccaatggcttcatagctctagtaaatgtcattgactgggttaacacacgaaagatctcctcagctgagcaaattctcactgctctggtggtctccagaattggtttactctgggtcatgttattcctttggtatgcaactgtgtttaattctgctttatatggtttagaagtaagaattgttgcttctaatgcctgggctgtaacgaaccatttcagcatgtggcttgctgctagcctcagcatattttgtttgctcaagattgccaatttctccaaccttatttctctccacctaaagaagagaattaagagtgttgttctggtgatactgttggggcccttggtatttttgatttgtaatcttgctgtgataaccatggatgagagagtgtggacaaaagaatatgaaggaaatgtgacttggaagatcaaattgaggaatgcaatacacctttcaagcttgactgtaactactctagcaaacctcataccctttactctgagcctaatatgttttctgctgttaatctgttctctttgtaaacatctcaagaagatgcggctccatagcaaaggatctcaagatcccagcaccaaggtccatataaaagctttgcaaactgtgacctccttcctcatgttatttgccatttactttctgtgtataatcacatcaacttggaatcttaggacacagcagagcaaacttgtactcctgctttgccaaactgttgcaatcatgtatccttcattccactcattcatcctgattatgggaagtaggaagctaaaacagacctttctttcagttttgtggcagatgacatgctgagtgaaagaagagaaaccctcaactccatagattcacaaggggagcatcgtggg

SEQ ID NO: 189277 - DNA, 1381 bp, Homo sapiens
  Payload ID: 17371
  Gene Symbol: TAS2R20
  Gene Name: taste receptor, type 2, member 20
  Uniprot ID: P59543
  ENST ID: ENST00000538986
  CDS Start-End: 1-930
atgatgagttttctacacattgttttttccattctagtagtggttgcatttattcttggaaattttgccaatggctttatagcactgataaatttcattgcctgggtcaagagacaaaagatctcctcagctgatcaaattattgctgctctggcagtctccagagttggtttgctctgggtaatattattacattggtattcaactgtgttgaatccaacttcatctaatttaaaagtaataatttttatttctaatgcctgggcagtaaccaatcatttcagcatctggcttgctactagcctcagcatattttatttgctcaagatcgtcaatttctccagacttatttttcatcacttaaaaaggaaggctaagagtgtagttctggtgatagtgttggggtctttgttctttttggtttgtcaccttgtgatgaaacacacgtatataaatgtgtggacagaagaatgtgaaggaaacgtaacttggaagatcaaactgaggaatgcaatgcacctttccaacttgactgtagccatgctagcaaacttgataccattcactctgaccctgatatcttttctgctgttaatctactctctgtgtaaacatctgaagaagatgcagctccatggcaaaggatctcaagatcccagcaccaagatccacataaaagctctgcaaactgtgacctccttcctcatattacttgccatttactttctgtgtctaatcatatcgttttggaattttaagatgcgaccaaaagaaattgtcttaatgctttgccaagcttttggaatcatatatccatcattccactcattcattctgatttgggggaacaagacgctaaagcagacctttctttcagttttgtggcaggtgacttgctgggcaaaaggacagaaccagtcaactccatagattcacaagaggtgcattgtgtgttttctagcagaaaacaaattgatggtgtctggaacattttatatttcccacaagtttttccgtagtctatgtatttgagtaatttccaaaagttgacatagaaaagtcttttacctaagtttattatataaaagtatatatatataatatacatttgcgtgtgtgtgtatgtctgaatgtatatgaaaatttaatatttaccataacatacctttaatcaacttttcatataaactgttcagttataccaaagtaggataagaaatttctcagaattatgaacccatgtgtatttcacacatttttttatatgatatttcatttgaggaatttatgatctctatttataattaagaactgacagcttatatcagaaaatcattgctgtttttcgttgtaaaatcattgctgtttttcgttgtaattt

SEQ ID NO: 189278 - DNA, 1381 bp, Homo sapiens; identical to SEQ ID NO: 189277
  Payload ID: 17371
  Gene Symbol: TAS2R20
  Gene Name: taste receptor, type 2, member 20
  Uniprot ID: P59543
  ENST ID: ENST00000570941
  CDS Start-End: 1-930

SEQ ID NO: 189279 - DNA, 1381 bp, Homo sapiens
  Payload ID: 17371
  Gene Symbol: TAS2R20
  Gene Name: taste receptor, type 2, member 20
  ENST ID: ENST00000634193
  CDS Start-End: 1-930
atgatgagttttctacacattgttttttccattctagtagtggttgcatttattcttggaaattttgccaatggctttatagcactgataaatttcattgcctgggtcaagagacaaaagatctcctcagctgatcaaattattgctgctctggcagtctccagagttggtttgctctgggtaatattattacattggtattcaactgtgttgaatccaacttcatctaatttagaagtaataatttttatttctaatgcctgggcagtaaccaatcatttcagcatctggcttgctactagcctcagcatattttatttgctcaagatcgtcaatttctccagacttatttttcatcacttaaaaaggaaggctaagagtgtagttctggtgatagtgttggggtctttgttctttttggtttgtcaccttgtgatgaaacacacgtatataaatgtgtggacagaagaatgtgaaggaaacgtaacttggaagatcaaactgaggaatgcaatgcacctttccaacttgactgtagccatgctagcaaacttgataccattcactctgaccctgatatcttttctgctgttaatctactctctgtgtaaacatctgaagaagatgcagctccatggcaaaggatctcaagatcccagcaccaagatccacataaaagctctgcaaactgtgacctccttcctcatattacttgccatttactttctgtgtctaatcatatcgttttggaattttaagatgcgaccaaaagaaattgtcttaatgctttgccaagcttttggaatcatatatccatcattccactcattcattctgatttgggggaacaagacgctaaagcagacctttctttcagttttgtggcaggtgacttgctgggcaaaaggacagaaccagtcaactccatagattcacaagaggtgcattgtgtgttttctagcagaaaacaaattgatggtgtctggaacattttatatttcccacaagtttttccgtagtctatgtatttgagtaatttccaaaagttgacatagaaaagtcttttacctaagtttattatatacaagtatatatatataatatacatttgcgtgtgtgtgtatgtctgaatgtatatgaaaatttaatatttaccataacatacctttaatcaacttttcatataaactgttcagttataccaaagtaggataagaaatttctcagaattatgaacccatgtgtatttcacacatttttttatatgatatttcatttgaggaatttatgatctctatttataattaagaactgacagcttatatcagaaaatcattgctgtttttcgttgtaaaatcattgctgtttttcgttgtaattt

SEQ ID NO: 189280 - DNA, 1101 bp, Homo sapiens
  Payload ID: 17372
  Gene Symbol: TAS2R3
  Gene Name: taste receptor, type 2, member 3
  Uniprot ID: Q9NYW6
  ENST ID: ENST00000247879
  CDS Start-End: 63-1013
tcagtgaggagattctatgtatcaacagaaagaacaaagatcagggctgcctaattgctgacatgatgggactcaccgagggggtgttcctgattctgtctggcactcagttcacactgggaattctggtcaattgtttcattgagttggtcaatggtagcagctggttcaagaccaagagaatgtctttgtctgacttcatcatcaccaccctggcactcttgaggatcattctgctgtgtattatcttgactgatagttttttaatagaattctctcccaacacacatgattcagggataataatgcaaattattgatgtttcctggacatttacaaaccatctgagcatttggcttgccacctgtcttggtgtcctctactgcctgaaaatcgccagtttctctcaccccacattcctctggctcaagtggagagtttctagggtgatggtatggatgctgttgggtgcactgctcttatcctgtggtagtaccgcatctctgatcaatgagtttaagctctattctgtctttaggggaattgaggccaccaggaatgtgactgaacacttcagaaagaagaggagtgagtattatctgatccatgttcttgggactctgtggtacctgcctcccttaattgtgtccctggcctcctactctttgctcatcttctccctggggaggcacacacggcagatgctgcaaaatgggacaagctccagagatccaaccactgaggcccacaagagggccatcagaatcatcctttccttcttctttctcttcttactttactttcttgctttcttaattgcatcatttggtaatttcctaccaaaaaccaagatggctaagatgattggcgaagtaatgacaatgttttatcctgctggccactcatttattctcattctggggaacagtaagctgaagcagacatttgtagtgatgctccggtgtgagtctggtcatctgaagcctggatccaagggacccattttctcttagagtaacagagggcatggggtggagcccttgagccttttggcctggctcaagactacaggactcttcctgaccttcctatgttaccagt

SEQ ID NO: 189281 - DNA, 1687 bp, Homo sapiens
  Payload ID: 17373
  Gene Symbol: TAS2R30
  Gene Name: taste receptor, type 2, member 30
  Uniprot ID: P59541
  ENST ID: ENST00000539585
  CDS Start-End: 401-1360
gtcgctaaagacaaatgatggagaggttacacaaggaaaaattgcaaacactggaagtgaacatgtccttgtttgcatactagcaaatgagaattcaggtttcatgtcaatttcagtatgaataattccagcctataacaagaacagatggtgaatgagtcagttaatttgaattgttttgaaaataagaatgttttccataaagagagcattgaacttatccattagcatgccatggtgatttctgacttgacactggtcacagcaattaaaagtaaaaagaatgtcacagcacatacacaaatcaggtgcatatagaatttaaggtcaggatattcaagcaatcacaaccagtgatattacaccagcattttaaaaatttctttttgtctgttcagacatgataacttttctgcccatcattttttccattctaatagtggttatatttgttattggaaattttgctaatggcttcatagcattggtaaattccattgagtgggtcaagagacaaaagatctcctttgttgaccaaattctcactgctctggcggtctccagagttggtttgctctgggtgttattactacattggtatgcaactcagttgaatccagctttttatagtgtagaagtaagaattactgcttataatgtctgggcagtaaccaaccatttcagcagctggcttgctactagcctcagcatgttttatttgctcaggattgccaatttctccaaccttatttttcttcgcataaagaggagagttaagagtgttgttctggtgatactgttggggcctttgctatttttggtttgtcatctttttgtgataaacatggatgagactgtatggacaaaagaatatgaaggaaacgtgacttggaagatcaaattgaggagtgcaatgtaccattcaaatatgactctaaccatgctagcaaactttgtacccctcactctgaccctgatatcttttctgctgttaatctgttctctgtgtaaacatctcaagaagatgcagctccatggcaaaggatctcaagatcccagcaccaaggtccacataaaagctttgcaaactgtgacctcctttcttctgttatgtgccatttactttctgtccatgatcatatcagtttgtaattttgggaggctggaaaagcaacctgtcttcatgttctgccaagctattatattcagctatccttcaacccacccattcatcctgattttgggaaacaagaagctaaagcagatttttctttcagttttgcggcatgtgaggtactgggtgaaagacagaagccttcgtctccatagattcacaagaggggcattgtgtgtcttctagcagaaaacaaactggtggtgtatgaaacattttatatttcttactgggttttctgtaatatatgtatatgaataatttccacatgtatacctagaaaagtcttttacctaaagttagtctagaaaagtacatatatatagatgtgtgtgtgtgtgtgtgtgtgtatgaaaaactgaagaacattgacaataacatgctttttattgttttttcacaaaaactgccaaattatagaaaatatgacaaaaattcctcaattatgaagccatgtttatttcatacatgtattttatatttcatttgtagaatttatatctatttataatt

SEQ ID NO: 189282 - DNA, 1687 bp, Homo sapiens; identical to SEQ ID NO: 189281
  Payload ID: 17373
  Gene Symbol: TAS2R30
  Gene Name: taste receptor, type 2, member 30
  Uniprot ID: P59541
  ENST ID: ENST00000576640
  CDS Start-End: 401-1360

SEQ ID NO: 189283 - DNA, 927 bp, Homo sapiens
  Payload ID: 17373
  Gene Symbol: TAS2R30
  Gene Name: taste receptor, type 2, member 30
  ENST ID: ENST00000617188
  CDS Start-End: 1-927
atgataacttttctgcccatcattttttccattctaatagtggttatatttgttattggaaattttgctaatggcttcatagcattggtaaattccattgagtgggtcaagagacaaaagatctcctttgttgaccaaattctcactgctctggcggtctccagagttggtttgctctgggtgttattactacattggtatgcaactcagttgaatccagctttttatagtgtagaagtaagaattactgcttataatgtctgggcagtaaccaaccatttcagcagctggcttgctactagcctcagcatgttttatttgctcaggattgccaatttctccaaccttatttttcttcgcataaagaggagagttaagagtgttgttctggtgatactgttggggcctttgctatttttggtttgtcatctttttgtgataaacatggatgagactgtatggacaaaagaatatgaaggaaacgtgacttggaagatcaaattgaggagtgcaatgtaccattcaaatatgactctaaccatgctagcaaactttgtacccctcactctgaccctgatatcttttctgctgttaatctgttctctgtgtaaacatctcaagaagatgcagctccatggcaaaggatctcaagatcccagcaccaaggtccacataaaagctttgcaaactgtgacctcctttcttatgttatttgccatttactttctgtgtataatcacatcaacttggaatcctaggacacagcagagcaatcttgtattcctgctttaccaaactcttgcaatcatgtatccttcattccactcattcatcctgattatgagaagtaggaagctaaaacagacctctctttcagttttgtgtcaggtgacgtgctgggtgaaacagaaaccctcaactccatag

SEQ ID NO: 189284 - DNA, 927 bp, Homo sapiens
  Payload ID: 17373
  Gene Symbol: TAS2R30
  Gene Name: taste receptor, type 2, member 30
  ENST ID: ENST00000622325
  CDS Start-End: 1-927
atgataacttttctgcccatcattttttccattctaatagtggttatatttgtgattggaaattttgctaatggcttcatagcattggtaaattccattgagtgggtcaagagacaaaagatctcctttgttgaccaaattctcactgctctggcggtctccagagttggtttgctctgggtgttattactacattggtatgcaactcagttgaatccagctttttatagtgtagaagtaagaattactgcttataatgtctgggcagtaaccaaccatttcagcagctggcttgctactagcctcagcatgttttatttgctcaggattgccaatttctccaaccttatttttcttcgcataaagaggagagttaagagtgttgttctggtgatactgttggggcctttgctatttttggtttgtcatctttttgtgataaacatggatgagactgtatggacaaaagaatatgaaggaaacgtgacttggaagatcaaattgaggagtgcaatgtaccattcaaatatgactctaaccatgctagcaaactttgtacccctcactctgaccctgatatcttttctgctgttaatctgttctctgtgtaaacatctcaagaagatgcagctccatggcaaaggatctcaagatcccagcaccaaggtccacataaaagctttgcaaactgtgacctcctttcttctgttatttgccatttactttctgtgtataatcacatcaacttggaatcctaggacacagcagagcaatcttgtattcctgctttaccaaactcttgcaatcatgtatccttcattccactcattcatcctgattatgagaagtaggaagctaaaacagacctctctttcagttttgtgtcaggtgacgtgctgggtgaaacagaaaccctcaactccatag

SEQ ID NO: 189285 - DNA, 960 bp, Homo sapiens
  Payload ID: 17373
  Gene Symbol: TAS2R30
  Gene Name: taste receptor, type 2, member 30
  ENST ID: ENST00000632763
  CDS Start-End: 1-960
atgataacttttctgcccatcattttttccattctaatagtggttatatttgtgattggaaattttgctaatggcttcatagcattggtaaattccattgagtgggtcaagagacaaaagatctcctttgttgaccaaattctcactgctctggcggtctccagagttggtttgctctgggtgttattactacattggtatgcaactcagttgaatccagctttttatagtgtagaagtaagaattactgcttataatgtctgggcagtaaccaaccatttcagcagctggcttgctactagcctcagcatgttttatttgctcaggattgccaatttctccaaccttatttttcttcgcataaagaggagagttaagagtgttgttctggtgatactgttggggcctttgctatttttggtttgtcatctttttgtgataaacatggatgagactgtatggacaaaagaatatgaaggaaacgtgacttggaagatcaaattgaggagtgcaatgtaccattcaaatatgactctaaccatgctagcaaactttgtacccctcactctgaccctgatatcttttctgctgttaatctgttctctgtgtaaacatctcaagaagatgcagctccatggcaaaggatctcaagatcccagcaccaaggtccacataaaagctttgcaaactgtgacctcctttcttctgttatgtgccatttactttctgtccatgatcatatcagtttgtaatttggggaggctggaaaagcaacctgtcttcatgttctgccaagctattatattcagctatccttcaacccacccattcatcctgattttgggaaacaagaagctaaagcagatttttctttcagttttgcggcatgtgaggtactgggtgaaagacagaagccttcgtctccatagattcacaagaggggcattgtgtgtcttctag

SEQ ID NO: 189286 - DNA, 1021 bp, Homo sapiens
  Payload ID: 17374
  Gene Symbol: TAS2R31
  Gene Name: taste receptor, type 2, member 31
  Uniprot ID: P59538
  ENST ID: ENST00000390675
  CDS Start-End: 73-1002
cgaacccacctgcaggaaccaactccggacacaacaccagcattaaaacaatttttttttgtctgttcagacatgacaacttttatacccatcattttttccagtgtggtagtggttctatttgttattggaaattttgctaatggcttcatagcattggtaaattccattgagcgggtcaagagacaaaagatctcttttgctgaccagattctcactgctctggcggtctccagagttggtttgctctgggtattattattaaattggtattcaactgtgtttaatccagctttttatagtgtagaagtaagaactactgcttataatgtctgggcagtaaccggccatttcagcaactggcttgctactagcctcagcatattttatttgctcaagattgccaatttctccaaccttatttttcttcacttaaagaggagagttaagagtgtcattctggtgatgctgttggggcctttactatttttggcttgtcaactttttgtgataaacatgaaagagattgtacggacaaaagaatatgaaggaaacttgacttggaagatcaaattgaggagtgcagtgtacctttcagatgcgactgtaaccacgctaggaaacttagtgcccttcactctgaccctgctatgttttttgctgttaatctgttctctgtgtaaacatctcaagaagatgcagctccatggtaaaggatctcaagatcccagcaccaaggtccacataaaagctttgcaaactgtgatctttttcctcttgttatgtgccgtttactttctgtccataatgatatcagtttggagttttgggagtctggaaaacaaacctgtcttcatgttctgcaaagctattagattcagctatccttcaatccacccattcatcctgatttggggaaacaagaagctaaagcagacttttctttcagttttgcggcaagtgaggtactgggtgaaaggagagaagccttcatctccatagattcatgagaggggcattg

SEQ ID NO: 189287 - DNA, 1021 bp, Homo sapiens; identical to SEQ ID NO: 189286
  Payload ID: 17374
  Gene Symbol: TAS2R31
  Gene Name: taste receptor, type 2, member 31
  Uniprot ID: P59538
  ENST ID: ENST00000572376
  CDS Start-End: 73-1002

SEQ ID NO: 189288 - DNA, 1004 bp, Homo sapiens
  Payload ID: 17374
  Gene Symbol: TAS2R31
  Gene Name: taste receptor, type 2, member 31
  ENST ID: ENST00000616314
  CDS Start-End: 57-956
tcacaaccagtgatattacaccagcattttaaaaatttctttttgtctgttcagacatgataacttttctgcccatcattttttccattctaatagtggttctatttgttattggaaattttgctaatggcttcatagcattggtaaattccattgagcgggtcaagagacaaaagatctcttttgctgaccagattctcactgctctggcggtctccagagttggtttgctctgggtattattattaaattggtattcaactgtgtttaatccagctttttatagtgtagaagtaagaactactgcttataatgtctgggcagtaaccggccatttcagcaactggcttgctactagcctcagcatattttatttgctcaagattgccaatttctccaaccttatttttcttcacttaaagaggagagttaagagtgtcattctggtgatgctgttggggcctttactatttttggcttgtcaactttttgtgataaacatgaaagagattgtacggacaaaagaatatgaaggaaacttgacttggaagatcaaattgaggagtgcagtgtacctttcagatgcgactgtaaccacgctaggaaacttagtgcccttcactctgaccctgctatgttttttgctgttaatctgttctctgtgtaaacatctcaagaagatgcagctccatggtaaaggatctcaagatcccagcaccaaggtccacataaaagctttgcaaactgtgatctttttcctcttgttatgtgccgtttactttctgtccataatgatatcagtttggagttttgggagtctggaaaacaaacctgtcttcatgttctgcaaagctattagattcagctatccttcaatccacccattcatcctgatttggggaaacaagaagctaaagcagacttttctttcagttttgcggcaagtgaggtactgggtgaaaggagagaagccttcatctccatagattcatgagaggggcatt

SEQ ID NO: 189289 - DNA, 1021 bp, Homo sapiens
  Payload ID: 17374
  Gene Symbol: TAS2R31
  Gene Name: taste receptor, type 2, member 31
  ENST ID: ENST00000631720
  CDS Start-End: 73-1002
cgaacccacctgcaggaaccaactccggacacaacaccagcattaaaacaatttttttttgtctgttcagacatgacaacttttatacccatcattttttccagtgtggtagtggttctatttgttattggaaattttgctaatggcttcatagcattggtaaattccattgagtgggtcaagagacaaaagatctcttttgctgaccagattctcactgctctggcggtctccagagttggtttgctctgggtattattattaaattggtattcaactgtgtttaatccagctttttatagtgtagaagtaagaactactgcttataatgtctgggcagtaaccggccatttcagcaactggcttgctactagcctcagcatattttatttgctcaagattgccaatttctccaaccttatttttcttcacttaaagaggagagttaagagtgtcattctggtgatgctgttggggcctttactatttttggcctgtcaactttttgtgataaacatgaaagagattgtacggacaaaagaatatgaaggaaacatgacttggaagatcaaattgaggagtgcagtgtacctttcagatgcgactgtaaccacgctaggaaacttagtgcccttcactctgaccctgctatgttttttgctgttaatctgttctctgtgtaaacatctcaagaagatgcagctccatggtaaaggatctcaagatcccagcaccaaggtccacataaaagttttgcaaactgtgatctttttcctcttgttatgtgccatttactttctgtccataatgatatcagtttggagttttgggagtctggaaaacaaacctgtcttcatgttctgcaaagctattagattcagctatccttcaatccacccattcatcctgatttggggaaacaagaagctaaagcagacttttctttcagttttgcggcaagtgaggtactgggtgaaaggagagaagccttcatctccatagattcatgagaggggcattg

SEQ ID NO: 189290 - DNA, 1143 bp, Homo sapiens
  Payload ID: 17375
  Gene Symbol: TAS2R38
  Gene Name: taste receptor, type 2, member 38
  Uniprot ID: P59533
  ENST ID: ENST00000547270
  CDS Start-End: 85-1086
cctttctgcactgggtggcaaccaggtctttagattagccaactagagaagagaagtagaatagccaattagagaagtgacatcatgttgactctaactcgcatccgcactgtgtcctatgaagtcaggagtacatttctgttcatttcagtcctggagtttgcagtggggtttctgaccaatgccttcgttttcttggtgaatttttgggatgtagtgaagaggcaggcactgagcaacagtgattgtgtgctgctgtgtctcagcatcagccggcttttcctgcatggactgctgttcctgagtgctatccagcttacccacttccagaagttgagtgaaccactgaaccacagctaccaagccatcatcatgctatggatgattgcaaaccaagccaacctctggcttgctgcctgcctcagcctgctttactgctccaagctcatccgtttctctcacaccttcctgatctgcttggcaagctgggtctccaggaagatctcccagatgctcctgggtattattctttgctcctgcatctgcactgtcctctgtgtttggtgcttttttagcagacctcacttcacagtcacaactgtgctattcatgaataacaatacaaggctcaactggcagattaaagatctcaatttattttattcctttctcttctgctatctgtggtctgtgcctcctttcctattgtttctggtttcttctgggatgctgactgtctccctgggaaggcacatgaggacaatgaaggtctataccagaaactctcgtgaccccagcctggaggcccacattaaagccctcaagtctcttgtctcctttttctgcttctttgtgatatcatcctgtgctgccttcatctctgtgcccctactgattctgtggcgcgacaaaataggggtgatggtttgtgttgggataatggcagcttgtccctctgggcatgcagccatcctgatctcaggcaatgccaagttgaggagagctgtgatgaccattctgctctgggctcagagcagcctgaaggtaagagccgaccacaaggcagattcccggacactgtgctgagaatggacatgaaatgagctcttcattaatacgcctgtgagtcttcataaatatgcc

SEQ ID NO: 189291 - DNA, 1017 bp, Homo sapiens
  Payload ID: 17376
  Gene Symbol: TAS2R39
  Gene Name: taste receptor, type 2, member 39
  Uniprot ID: P59534
  ENST ID: ENST00000446620
  CDS Start-End: 1-1017
atgctagggagatgttttcctccagacaccaaagagaagcaacagctcagaatgactaaactctgcgatcctgcagaaagtgaattgtcgccatttctcatcaccttaattttagcagttttacttgctgaatacctcattggtatcattgcaaatggtttcatcatggctatacatgcagctgaatgggttcaaaataaggcagtttccacaagtggcaggatcctggttttcctgagtgtatccagaatagctctccaaagcctcatgatgttagaaattaccatcagctcaacctccctaagtttttattctgaagacgctgtatattatgcattcaaaataagttttatattcttaaatttttgtagcctgtggtttgctgcctggctcagtttcttctactttgtgaagattgccaatttctcctacccccttttcctcaaactgaggtggagaattactggattgataccctggcttctgtggctgtccgtgtttatttccttcagtcacagcatgttctgcatcaacatctgcactgtgtattgtaacaattctttccctatccactcctccaactccactaagaaaacatacttgtctgagatcaatgtggtcggtctggcttttttctttaacctggggattgtgactcctctgatcatgttcatcctgacagccaccctgctgatcctctctctcaagagacacaccctacacatgggaagcaatgccacagggtccaacgaccccagcatggaggctcacatgggggccatcaaagctatcagctactttctcattctctacattttcaatgcagttgctctgtttatctacctgtccaacatgtttgacatcaacagtctgtggaataatttgtgccagatcatcatggctgcctaccctgccagccactcaattctactgattcaagataaccctgggctgagaagagcctggaagcggcttcagcttcgacttcatctttacccaaaagagtggactctgtga

SEQ ID NO: 189292 - DNA, 2378 bp, Homo sapiens
  Payload ID: 17377
  Gene Symbol: TAS2R4
  Gene Name: taste receptor, type 2, member 4
  Uniprot ID: Q9NYW5
  ENST ID: ENST00000247881
  CDS Start-End: 48-947
tgcctccactatcagcaccacaactgctgaatcctcaatgagtaaagatgcttcggttattctatttctctgctattattgcctcagttattttaaattttgtaggaatcattatgaatctgtttattacagtggtcaattgcaaaacttgggtcaaaagccatagaatctcctcttctgataggattctgttcagcctgggcatcaccaggtttcttatgctgggactatttctggtgaacaccatctacttcgtctcttcaaatacggaaaggtcagtctacctgtctgctttttttgtgttgtgtttcatgtttttggactcgagcagtgtctggtttgtgaccttgctcaatatcttgtactgtgtgaagattactaacttccaacactcagtgtttctcctgctgaagcggaatatctccccaaagatccccaggctgctgctggcctgtgtgctgatttctgctttcaccacttgcctgtacatcacgcttagccaggcatcaccttttcctgaacttgtgactacgagaaataacacatcatttaatatcagtgagggcatcttgtctttagtggtttctttggtcttgagctcatctctccagttcatcattaatgtgacttctgcttccttgctaatacactccttgaggagacatatacagaagatgcagaaaaatgccactggtttctggaatccccagacggaagctcatgtaggtgctatgaagctgatggtctatttcctcatcctctacattccatattcagttgctaccctggtccagtatctccccttttatgcagggatggatatggggaccaaatccatttgtctgatttttgccaccctttactctccaggacattctgttctcattattatcacacatcctaaactgaaaacaacagcaaagaagattctttgtttcaaaaaatagtggaatttcagtaaacaatacctagatttacctgatggtttgggggcaagattttctgtttgcagttttcccagtgatctggggaattcagttttgtgattgctgatctgacatcataggcttttgagtgcctgaatttcagttcattctgtaattttttttttttggtatgtaagtattttaaaataaggcacattctgtaagaaacttttttgaggcattatttgtcatgtattttgcatggccattgaatccatgtataatggaaatcatcacattgtttcattgtctattgaagtataatgggaaattcttccaaattagagaacacattggggtgcacgtgatgagttagatatttgtggtttagctgaggagccctgagtaagggctcagcagtggataggtggtcactgggagccactggactgaccgaaagcagaggaagggggttcagtgcaaagagaaaaggaaaaaaggaaggtttcagagagaaaagaaggaaagagaaaggtgaagagaaataggcgtacactgggccaggcgcggtggctcatgcttgtaatcccagctctttgggaggccgaggcaggtgaatcgtgaggtcaggagatcgagaccatcctggctaacacggtgaaaccctgtctctactaaaaatacaaaaaaattagctgggcgtggtggcgggcacctgtagtcccagctactcgggaggctgaggcaggagaatggcttcaacccaggaggcggagcttgcagtgagatgagatcgcgccactgcactccagtctgggcgacagagcaagactctgtctcaaaaaaagaaatagacgtacactctgggacaagacagaaaaagtatcctcacacttgctgggtaatagtaactgtgctattcctagcaagaaaccctaaggtttctaggcttgttctggaaaagaggatattgccagagttggtaagtagaggaaagtgattagtatttaagaaactgaatcaagaatggttccaaaaatcttaaaatccagggaaaccagcttaaggtcaaaggcaagtgctagataatgaaattaacaccatatgagtacaaatttacaaaatactgtacttcaccataggctatggaactcagtggaaagccaaaaaagcactggacaggtggtgggagtgcttgacttgtggtgaatttatttcatctgcttatacatttgtacacagcacagttcttctccagaatgttgtttctgtggctgggaccattggactgtggctccaaaagaacaacagtctgaagatgggatgttgacaagttttggaatgtcaattggggaatcataatttgtatttatttaggttttttttggtgttcataaaatgcttatgtaatatttacatatgtcaaataaatcttaaaattttataaattac

SEQ ID NO: 189293 - DNA, 1043 bp, Homo sapiens
  Payload ID: 17378
  Gene Symbol: TAS2R40
  Gene Name: taste receptor, type 2, member 40
  Uniprot ID: P59535
  ENST ID: ENST00000408947
  CDS Start-End: 43-1014
cccattcttggcgcagaaacctgaaagtcaggatcaaagagaatggcaacggtgaacacagatgccacagataaagacatatccaagttcaaggtcaccttcactttggtggtctccggaatagagtgcatcactggcatccttgggagtggcttcatcacggccatctatggggctgagtgggccaggggcaaaacactccccactggtgaccgcattatgttgatgctgagcttttccaggctcttgctacagatttggatgatgctggagaacattttcagtctgctattccgaattgtttataaccaaaactcagtgtatatcctcttcaaagtcatcactgtctttctgaaccattccaatctctggtttgctgcctggctcaaagtcttctattgtcttagaattgcaaacttcaatcatcctttgttcttcctgatgaagaggaaaatcatagtgctgatgccttggcttctcaggctgtcagtgttggtttccttaagcttcagctttcctctctcgagagatgtcttcaatgtgtatgtgaatagctccattcctatcccctcctccaactccacggagaagaagtacttctctgagaccaatatggtcaacctggtatttttctataacatggggatcttcgttcctctgatcatgttcatcctggcagccaccctgctgatcctctctctcaagagacacaccctacacatgggaagcaatgccacagggtccagggaccccagcatgaaggctcacataggggccatcaaagccaccagctactttctcatcctctacattttcaatgcaattgctctatttctttccacgtccaacatctttgacacttacagttcctggaatattttgtgcaagatcatcatggctgcctaccctgccggccactcagtacaactgatcttgggcaaccctgggctgagaagagcctggaagcggtttcagcaccaagttcctctttacctaaaagggcagactctgtgactggaactcacggagttctgcgggacctg

SEQ ID NO: 189294 - DNA, 924 bp, Homo sapiens
  Payload ID: 17379
  Gene Symbol: TAS2R41
  Gene Name: taste receptor, type 2, member 41
  Uniprot ID: P59536
  ENST ID: ENST00000408916
  CDS Start-End: 1-924
atgcaagcagcactgacggccttcttcgtgttgctctttagcctgctgagtcttctggggattgcagcgaatggcttcattgtgctggtgctgggcagggagtggctgcgatatggcaggttgctgcccttggatatgatcctcattagcttgggtgcctcccgcttctgcctgcagttggttgggacggtgcacaacttctactactctgcccagaaggtcgagtactctgggggtctcggccgacagttcttccatctacactggcacttcctgaactcagccaccttctggttttgcagctggctcagtgtcctgttctgtgtgaagattgctaacatcacacactccaccttcctgtggctgaagtggaggttcccagggtgggtgccctggctcctgttgggctctgtcctgatctccttcatcataaccctgctgtttttttgggtgaactaccctgtatatcaagaatttttaattagaaaattttctgggaacatgacctacaagtggaatacaaggatagaaacatactatttcccatccctgaaactggtcatctggtcaattcctttttctgtttttctggtctcaattatgctgttaattaattctctgaggaggcatactcagagaatgcagcacaacgggcacagcctgcaggaccccagcacccaggctcacaccagagctctgaagtccctcatctccttcctcattctttatgctctgtcctttctgtccctgatcattgatgccgcaaaatttatctccatgcagaacgacttttactggccatggcaaattgcagtctacctgtgcatatctgtccatcccttcatcctcatcttcagcaacctcaagcttcgaagcgtgttctcgcagctcctgttgttggcaaggggcttctgggtggcctag

SEQ ID NO: 189295 - DNA, 945 bp, Homo sapiens
  Payload ID: 17380
  Gene Symbol: TAS2R42
  Gene Name: taste receptor, type 2, member 42
  Uniprot ID: Q7RTR8
  ENST ID: ENST00000334266
  CDS Start-End: 1-945
atggccaccgaattggacaaaatctttctgattctggcaatagcagaattcatcatcagcatgctggggaatgtgttcattggactggtaaactgctctgaagggatcaagaaccaaaaggtcttctcagctgacttcatcctcacctgcttggctatctccacaattggacaactgttggtgatactgtttgattcatttctagtgggacttgcttcacatttatataccacatatagactaggaaaaactgttattatgctttggcacatgactaatcacttgacaacctggcttgccacctgcctaagcattttctatttctttaagatagcccacttcccccactcccttttcctctggctgaggtggaggatgaacggaatgattgttatgcttcttatattgtctttgttcttactgatttttgacagtttagtgctagaaatatttattgatatctcactcaatataatagataaaagtaatctgactttatatttagatgaaagtaaaactctctatgataaactctctattttaaaaactcttctcagcttgaccagttttatccccttttctctgttcctgacctccttgctttttttatttctgtccttggtgagacatactagaaatttgaagctcagttccttgggctctagagactccagcacagaggcccataggagggccatgaaaatggtgatgtctttccttttcctcttcatagttcattttttttccttacaagtggccaattggatattttttatgttgtggaacaacaagtgcataaagtttgtcatgttagccttaaatgcctttccctcgtgccactcatttattctcattctgggaaacagcaagctgcaacagacagctgtgaggctactgtggcatcttaggaactatacaaaaacaccaaaccctttacctttgtag

SEQ ID NO: 189296 - DNA, 945 bp, Homo sapiens; identical to SEQ ID NO: 189295
  Payload ID: 17380
  Gene Symbol: TAS2R42
  Gene Name: taste receptor, type 2, member 42
  ENST ID: ENST00000619463
  CDS Start-End: 1-945

SEQ ID NO: 189297 - DNA, 1027 bp, Homo sapiens
  Payload ID: 17381
  Gene Symbol: TAS2R43
  Gene Name: taste receptor, type 2, member 43
  Uniprot ID: P59537
  ENST ID: ENST00000531678
  CDS Start-End: 85-1014
tcagcgagaccacgaacccacctgcaggaaccaattccggacacaacaccagcatttaaaaaaattttttttgtctgttcagacatgataacttttctacccatcattttttccagtctggtagtggttacatttgttattggaaattttgctaatggcttcatagcactggtaaattccattgagtggttcaagagacaaaagatctcctttgctgaccaaattctcactgctctggcggtctccagagttggtttgctctgggtattattattaaactggtattcaactgtgttgaatccagcttttaatagtgtagaagtaagaactactgcttataatatctgggcagtgatcaaccatttcagcaactggcttgctactaccctcagcatattttatttgctcaagattgccaatttctccaactttatttttcttcacttaaagaggagagttaagagtgtcattctggtgatgttgttggggcctttgctatttttggcttgtcatctttttgtgataaacatgaatgagattgtgcggacaaaagaatttgaaggaaacatgacttggaagatcaaattgaagagtgcaatgtacttttcaaatatgactgtaaccatggtagcaaacttagtacccttcactctgaccctactatcttttatgctgttaatctgttctttgtgtaaacatctcaagaagatgcagctccatggtaaaggatctcaagatcccagcaccaaggtccacataaaagctttgcaaactgtgatctccttcctcttgttatgtgccatttactttctgtccataatgatatcagtttggagttttggaagtctggaaaacaaacctgtcttcatgttctgcaaagctattagattcagctatccttcaatccacccattcatcctgatttggggaaacaagaagctaaagcagacttttctttcagttttttggcaaatgaggtactgggtgaaaggagagaagacttcatctccatagattcacgagaggg

SEQ ID NO: 189298 - DNA, 1027 bp, Homo sapiens
  Payload ID: 17381
  Gene Symbol: TAS2R43
  Gene Name: taste receptor, type 2, member 43
  Uniprot ID: P59537
  ENST ID: ENST00000571879
  CDS Start-End: 85-1014
tcagcgagaccacgaacccacctgcaggaaccaattccggacacaacaccagcatttaaaaaaattttttttgtctgttcagacatgataacttttctacccatcattttttccagtctggtagtggttacatttgttattggaaattttgctaatggcttcatagcactggtaaattccattgagtcgttcaagagacaaaagatctcctttgctgaccaaattctcactgctctggcggtctccagagttggtttgctctgggtattattattaaactggtattcaactgtgttgaatccagcttttaatagtgtagaagtaagaactactgcttataatatctgggcagtgatcaaccatttcagcaactggcttgctactaccctcagcatattttatttgctcaagattgccaatttctccaactttatttttcttcacttaaagaggagagttaagagtgtcattctggtgatgttgttggggcctttgctatttttggcttgtcatctttttgtgataaacatgaatgagattgtgcggacaaaagaatttgaaggaaacatgacttggaagatcaaattgaagagtgcaatgtacttttcaaatatgactgtaaccatggtagcaaacttagtacccttcactctgaccctactatcttttatgctgttaatctgttctttgtgtaaacatctcaagaagatgcagctccgtggtaaaggatctcaagatcccagcacgaaggtccacataaaagctttgcaaactgtgatctccttcctcttgttatgtgccatttactttctgtccataatgatatcagtttggagttttggaagtctggaaaacaaacctgtcttcatgttctgcaaagctattagattcagctatccttcaatccacccattcatcctgatttggggaaacaagaagctaaagcagacttttctttcagttttttggcaaatgaggtactgggtgaaaggagagaagacttcatctccatagattcacgagaggg

SEQ ID NO: 189299 - DNA, 930 bp, Homo sapiens
  Payload ID: 17381
  Gene Symbol: TAS2R43
  Gene Name: taste receptor, type 2, member 43
  ENST ID: ENST00000617520
  CDS Start-End: 1-930
atgataacttttctgcccatcattttttccattctaatagtggttatatttgttattggaaattttgctaatggcttcatagcattggtaaattccattgagtgggtcaagagacaaaagatctcctttgttgaccaaattctcactgctctggcggtctccagagttggtttgctctgggtgttattactacattggtatgcaactcagttgaatccagctttttatagtgtagaagtaagaattactgcttataatgtctgggcagtaaccaaccatttcagcagctggcttgctactagcctcagcatgttttatttgctcaggattgccaatttctccaaccttatttttcttcgcataaagaggagagttaagagtgttgttctggtgatactgttggggcctttgctatttttggtttgtcatctttttgtgataaacatgaatcagattgtatggacaaaagaatttgaaggaaacatgacttggaagatcaaattgaagagtgcaatgtacttttcaaatatgactgtaaccatggtagcaaacttagtacccttcactctgaccctactatcttttatgctgttaatctgttctttgtgtaaacatctcaagaagatgcagctccgtggtaaaggatctcaagatcccagcacgaaggtccacataaaagctttgcaaactgtgatctccttcctcttgttatgtgccatttactttctgtccataatgatatcagtttggagttttggaagtctggaaaacaaacctgtcttcatgttctgcaaagctattagattcagctatccttcaatccacccattcatcctgatttggggaaacaagaagctaaagcagacttttctttcagttttttggcaaatgaggtactgggtgaaaggagagaagacttcatctccatag

SEQ ID NO: 189300 - DNA, 930 bp, Homo sapiens
  Payload ID: 17381
  Gene Symbol: TAS2R43
  Gene Name: taste receptor, type 2, member 43
  ENST ID: ENST00000610639
  CDS Start-End: 1-930
atgataacttttctgcccatcattttttccattctaatagtggttatatttgttattggaaattttgctaatggcttcatagcattggtaaattccattgagtggttcaagagacaaaagatctcctttgctgaccaaattctcactgctctggcggtctccagagttggtttgctctgggtattattattaaactggtattcaactgtgttgaatccagcttttaatagtgtagaagtaagaactactgcttataatatctgggcagtgatcaaccatttcagcaactggcttgctactaccctcagcatattttatttgctcaagattgccaatttctccaactttatttttcttcacttaaagaggagagttaagagtgtcattctggtgatgttgttggggcctttgctatttttggcttgtcatctttttgtgataaacatgaatgagattgtgcggacaaaagaatttgaaggaaacatgacttggaagatcaaattgaagagtgcaatgtacttttcaaatatgactgtaaccatggtagcaaacttagtacccttcactctgaccctactatcttttatgctgttaatctgttctttgtgtaaacatctcaagaagatgcagctccatggtaaaggatctcaagatcccagcaccaaggtccacataaaagctttgcaaactgtgatctccttcctcttgttatgtgccatttactttctgtccataatgatatcagtttggagttttggaagtctggaaaacaaacctgtcttcatgttctgcaaagctattagattcagctatccttcaatccacccattcatcctgatttggggaaacaagaagctaaagcagacttttctttcagttttttggcaaatgaggtactgggtgaaaggagagaagacttcatctccatag

SEQ ID NO: 189301 - DNA, 930 bp, Homo sapiens
  Payload ID: 17381
  Gene Symbol: TAS2R43
  Gene Name: taste receptor, type 2, member 43
  ENST ID: ENST00000632197
  CDS Start-End: 1-900
atgataacttttctgcccatcatattttccattctagtagtggttacatttgttattggaaattttgctaatggcttcatagcgttggtaaattccaccgagtgggtgaagagacaaaagatctcctttgctgaccaaattgtcactgctctggcggtctccagagttggtttgctctgggtgttattattaaattggtattcaactgtgttgaatccagctttttatagtgtagaattaagaactactgcttataatatctgggcagtaaccggccatttcagcaactggcctgctactagcctcagcatattttatttgctcaagattgccaatttctccaaccttatttttcttcgcttaaagaggagagttaagagtgtcattctggtggtgctgttggggcctttgctatttttggcttgtcatctttttgtggtaaacatgaatcagattgtatggacaaaagaatatgaaggaaacatgacttggaagatcaaattgaggcgtgcaatgtacctttcagatacgactgtaaccatgctagcaaacttagtaccctttactgtaaccctgatatcttttctgctgttagtctgttctctgtgtaaacatctcaagaagatgcagctccatggcaaaggatctcaagatcccagtaccaaggtccacataaaagttttgcaaactgtgatctccttcttcttgttacgtgccatttactttgtgtctgtaataatatcagtttggagttttaagaatctggaaaacaaacctgtcttcatgttctgccaagctattggattcagctgttcttcagcccacccgttcatcctgatttggggaaacaagaagctaaagcagacttatctttcagttttgtggcaaatgaggtactgagtgaaaggagagaagccttcatctccatag

SEQ ID NO: 189302 - DNA, 930 bp, Homo sapiens
  Payload ID: 17382
  Gene Symbol: TAS2R46
  Gene Name: taste receptor, type 2, member 46
  Uniprot ID: P59540
  ENST ID: ENST00000533467
  CDS Start-End: 1-930
atgataacttttctgcccatcattttttccattctaatagtggttacatttgtgattggaaattttgctaatggcttcatagcattggtaaattccattgagtggttcaagagacaaaagatctcttttgctgaccaaattctcactgctctggcagtctccagagttggtttactctgggtattagtattaaattggtatgcaactgagttgaatccagcttttaacagtatagaagtaagaattactgcttacaatgtctgggcagtaatcaaccatttcagcaactggcttgctactagcctcagcatattttatttgctcaagattgccaatttctccaaccttatttttcttcacttaaagaggagagttaagagtgttgttctggtgatactattggggcctttgctatttttggtttgtcatctttttgtgataaacatgaatcagattatatggacaaaagaatatgaaggaaacatgacttggaagatcaaactgaggagtgcaatgtacctttcaaatacaacggtaaccatcctagcaaacttagttcccttcactctgaccctgatatcttttctgctgttaatctgttctctgtgtaaacatctcaaaaagatgcagctccatggcaaaggatctcaagatcccagcatgaaggtccacataaaagctttgcaaactgtgacctccttcctcttgttatgtgccatttactttctgtccataatcatgtcagtttggagttttgagagtctggaaaacaaacctgtcttcatgttctgcgaagctattgcattcagctatccttcaacccacccattcatcctgatttggggaaacaagaagctaaagcagacttttctttcagttttgtggcatgtgaggtactgggtgaaaggagagaagccttcatcttcatag

SEQ ID NO: 189303 - DNA, 930 bp, Homo sapiens; identical to SEQ ID NO: 189302
  Payload ID: 17382
  Gene Symbol: TAS2R46
  Gene Name: taste receptor, type 2, member 46
  Uniprot ID: P59540
  ENST ID: ENST00000574263
  CDS Start-End: 1-930

SEQ ID NO: 189304 - DNA, 933 bp, Homo sapiens
  Payload ID: 17382
  Gene Symbol: TAS2R46
  Gene Name: taste receptor, type 2, member 46
  ENST ID: ENST00000622844
  CDS Start-End: 1-933
atgataacttttctacccatcattttttccagtctggtagtggttacatttgttattggaaattttgctaatggcttcatagcactggtaaattccattgagtcgttcaagagacaaaagatctcctttgctgaccaaattctcactgctctggcggtctccagagttggtttgctctgggtattattattaaactggtattcaactgtgttgaatccagcttcttttaacagtatagaagtaagaattactgcttacaatgtctgggcagtaatcaaccatttcagcaactggcttgctactagcctcagcatattttatttgctcaagattgccaatttctccaaccttatttttcttcacttaaagaggagagttaagagtgttgttctggtgatactattggggcctttgctatttttggtttgtcatctttttgtgataaacatgaatcagattatatggacaaaagaatatgaaggaaacatgacttggaagatcaaactgaggagtgcaatgtacctttcaaatacaacggtaaccatcctagcaaacttagttcccttcactctgaccctgatatcttttctgctgttaatctgttctctgtgtaaacatctcaaaaagatgcagctccatggcaaaggatctcaagatcccagcatgaaggtccacataaaagctttgcaaactgtgacctccttcctcttgttatgtgccatttactttctgtccataatcatgtcagtttggagttttgagagtctggaaaacaaacctgtcttcatgttctgcgaagctattgcattcagctatccttcaacccacccattcatcctgatttggggaaacaagaagctaaagcagacttttctttcagttttgtggcatgtgaggtactgggtgaaaggagagaagccttcatcttcatag

SEQ ID NO: 189305 - DNA, 960 bp, Homo sapiens
  Payload ID: 17382
  Gene Symbol: TAS2R46
  Gene Name: taste receptor, type 2, member 46
  ENST ID: ENST00000621490
  CDS Start-End: 1-960
atgataacttttctgcccatcattttttccattctaatagtggttacatttgtgattggaaattttgctaatggcttcatagcattggtaaattccattgagtggttcaagagacaaaagatctcttttgctgaccaaattctcactgctctggcagtctccagagttggtttactctgggtattagtattaaattggtatgcaactgagttgaatccagcttttaacagtatagaagtaagaattactgcttacaatgtctgggcagtaatcaaccatttcagcaactggcttgctactagcctcagcatattttatttgctcaagattgccaatttctccaaccttatttttcttcacttaaagaggagagttaagagtgttgttctggtgatactattggggcctttgctatttttggtttgtcatctttttgtgataaacatgaatcagattatatggacaaaagaatatgaaggaaacatgacttggaagatcaaactgaggagtgcaatgtacctttcaaatacaacggtaaccatcctagcaaacttagttcccttcactctgaccctgatatcttttctgctgttaatctgttctctgtgtaaacatctcaaaaagatgcagctccatggcaaaggatctcaagatcccagcatgaaggtccacataaaagctatgcaaactgtgacctccttcctcttgttatgtgccatttactttctgtccataatcatatcagtttggagttttgggagtctggaaaacaaacctgtcttcatgttctgcaaagctattagattcagctatccttcaatccacccattcatcctgatttggggaaacaagaagctaaagcagacttttctttcagttttgcggcaagtgaggtactgggtgaaagagagaagccttcatctccatagattcatgagaggggcattgtgtgtcttctag

SEQ ID NO: 189306 - DNA, 1018 bp, Homo sapiens
  Payload ID: 17382
  Gene Symbol: TAS2R46
  Gene Name: taste receptor, type 2, member 46
  ENST ID: ENST00000614128
  CDS Start-End: 73-999
cgaacccacctgcaggaaccaactccggatacaacaccagcattttaaaaatttctttttgtctgttcagacatgataacttttctgcccatcatattttccattctagtagtggttacatttgttattggaaattttgctaatggcttcatagcgttggtaaattccaccgagtgggtgaagagacaaaagatctcctttgctgaccaaattgtcactgctctggcggtctccagagttggtttgctctgggtgttattattaaattggtattcaactgtgttgaatccagctttttatagtgtagaattaagaactactgcttataatatctgggcagtaaccggccatttcagcaactggcctgctactagcctcagcatattttatttgctcaagattgccaatttctccaaccttatttttcttcgcttaaagaggagagttaagagtgtcattctggtggtgctgttggggcctttgctatttttggcttgtcatctttttgtgataaacatgaatcagattatatggacaaaagaatatgaaggaaacatgacttggaagatcaaactgaggagtgcaatgtacctttcaaatacaacggtaaccatcctagcaaacttagttcccttcactctgaccctgatatcttttctgctgttaatctgttctctgtgtaaacatctcaaaaagatgcagctccatggcaaaggatctcaagatcccagcatgaaggtccacataaaagctatgcaaactgtgacctccttcctcttgttatgtgccatttactttctgtccataatcatgtcagttagttttgagagtctggaaaacaaacctgtcttcatgttctgcgaagctattgcattcagctatccttcaacccacccattcatcctgatttggggaaacaagaagctaaagcagacttttctttcagttttgtggcatgtgaggtactgggtgaaaggagagaagccttcatcttcatagattcacaagagcagcattg

SEQ ID NO: 189307 - DNA, 930 bp, Homo sapiens
  Payload ID: 17382
  Gene Symbol: TAS2R46
  Gene Name: taste receptor, type 2, member 46
  ENST ID: ENST00000633803
  CDS Start-End: 1-750
atgataacttttctgcccatcattttttccattctaatagtggttacatttgtgattggaaattttgctaatggcttcatagcattggtaaattccattgagtggttcaagagacaaaagatctcttttgctgaccaaattctcactgctctggcagtctccagagttggtttactctgggtattagtattaaattggtatgcaactgagttgaatccagcttttaacagtatagaagtaagaattactgcttacaatgtctgggcagtaatcaaccatttcagcaactggcttgctactagcctcagcatattttatttgctcaagattgccaatttctccaaccttatttttcttcacttaaagaggagagttaagagtgttgttctggtgatactattggggcctttgctatttttggtttgtcatctttttgtgataaacatgaatcagattatatggacaaaagaatatgaaggaaacatgacttggaagatcaaactgaggagtgcaatgtacctttcaaatacaacggtaaccatcctagcaaacttagttcccttcactctgaccctgatatcttttctgctgttaatctgttctctgtgtaaacatctcaaaaagatgcagctccatggcaaaggatctcaagatcccagcatgaaggtccacataaaagctatgcaaactgtgacctccttcctcttgttatgtgccatttactttctgtccataatcatgtcagtttagagttttgagagtctggaaaacaaacctgtcttcatgttctgcgaagctattgcattcagctatccttcaacccacccattcatcctgatttggggaaacaagaagctaaagcagacttttctttcagttttgtggcatgtgaggtactgggtgaaaggagagaagccttcatcttcatag

SEQ ID NO: 189308 - DNA, 1151 bp, Homo sapiens
  Payload ID: 17383
  Gene Symbol: TAS2R5
  Gene Name: taste receptor, type 2, member 5
  Uniprot ID: Q9NYW4
  ENST ID: ENST00000247883
  CDS Start-End: 146-1045
cagctgttcagtctcgcttgaagacagattacggaaggacgaggccaaatccagattttgtggtgtgaaaatttaccctggtgtgttatcactaccaggggatctgacctcagccaggagcagtgagagcctcctctccccagccatgctgagcgctggcctaggactgctgatgctggtggcagtggttgaatttctcatcggtttaattggaaatggaagcctggtggtctggagttttagagaatggatcagaaaattcaactggtcctcatataacctcattatcctgggcctggctggctgccgatttctcctgcagtggctgatcattttggacttaagcttgtttccacttttccagagcagccgttggcttcgctatcttagtatcttctgggtcctggtaagccaggccagcttatggtttgccaccttcctcagtgtcttctattgcaagaagatcacgaccttcgatcgcccggcctacttgtggctgaagcagagggcctataacctgagtctctggtgccttctgggctactttataatcaatttgttacttacagtccaaattggcttaacattctatcatcctccccaaggaaacagcagcattcggtatccctttgaaagctggcagtacctgtatgcatttcagctcaattcaggaagttatttgcctttagtggtgtttcttgtttcctctgggatgctgattgtctctttgtatacacaccacaagaagatgaaggtccattcagctggtaggagggatgtccgggccaaggctcacatcactgcgctgaagtccttgggctgcttcctcttacttcacctggtttatatcatggccagccccttctccatcacctccaagacttatcctcctgatctcaccagtgtcttcatctgggagacactcatggcagcctatccttctcttcattctctcatattgatcatggggattcctagggtgaagcagacttgtcagaagatcctgtggaagacagtgtgtgctcggagatgctggggcccatgatctgggaagaaaagtgtggtcaggacactcttgggacgctcttttgatagctctctataagggagctgctttccatgtcttttaagattttccttcttttacacca

SEQ ID NO: 189309 - DNA, 1000 bp, Homo sapiens
  Payload ID: 17384
  Gene Symbol: TAS2R50
  Gene Name: taste receptor, type 2, member 50
  Uniprot ID: P59544
  ENST ID: ENST00000506868
  CDS Start-End: 53-952
tcacaaccagtgatattaggcttgcattttctttctttttttctgctcagatatgataacttttctatacatttttttttcaattctaataatggttttatttgttctcggaaactttgccaatggcttcatagcactggtaaatttcattgactgggtgaagagaaaaaagatctcctcagctgaccaaattctcactgctctggcggtctccagaattggtttgctctgggcattattattaaattggtatttaactgtgttgaatccagctttttatagtgtagaattaagaattacttcttataatgcctgggttgtaaccaaccatttcagcatgtggcttgctgctaacctcagcatattttatttgctcaagattgccaatttctccaaccttctttttcttcatttaaagaggagagttaggagtgtcattctggtgatactgttggggactttgatatttttggtttgtcatcttcttgtggcaaacatggatgagagtatgtgggcagaagaatatgaaggaaacatgactgggaagatgaaattgaggaatacagtacatctttcatatttgactgtaactaccctatggagcttcataccctttactctgtccctgatatcttttctgatgctaatctgttctctgtgtaaacatctcaagaagatgcagctccatggagaaggatcgcaagatctcagcaccaaggtccacataaaagctttgcaaactctgatctccttcctcttgttatgtgccattttctttctattcctaatcgtttcggtttggagtcctaggaggctgcggaatgacccggttgtcatggttagcaaggctgttggaaacatatatcttgcattcgactcattcatcctaatttggagaaccaagaagctaaaacacacctttcttttgattttgtgtcagattaggtgctgagtaaaagacctgaaactctcaactctctagattcacaagtgggacatt

SEQ ID NO: 189310 - DNA, 1000 bp, Homo sapiens; identical to SEQ ID NO: 189309
  Payload ID: 17384
  Gene Symbol: TAS2R50
  Gene Name: taste receptor, type 2, member 50
  Uniprot ID: P59544
  ENST ID: ENST00000575654
  CDS Start-End: 53-952

SEQ ID NO: 189311 - DNA, 1000 bp, Homo sapiens; identical to SEQ ID NO: 189309
  Payload ID: 17384
  Gene Symbol: TAS2R50
  Gene Name: taste receptor, type 2, member 50
  Uniprot ID: P59544
  ENST ID: ENST00000613831
  CDS Start-End: 53-952

SEQ ID NO: 189312 - DNA, 957 bp, Homo sapiens
  Payload ID: 17385
  Gene Symbol: TAS2R60
  Gene Name: taste receptor, type 2, member 60
  Uniprot ID: P59551
  ENST ID: ENST00000332690
  CDS Start-End: 1-957
atgaatggagaccacatggttctaggatcttcggtgactgacaagaaggccatcatcttggttaccattttactccttttacgcctggtagcaatagcaggcaatggcttcatcactgctgctctgggcgtggagtgggtgctacggagaatgttgttgccttgtgataagttattggttagcctaggggcctctcgcttctgtctgcagtcagtggtaatgggtaagaccatttatgttttcttgcatccgatggccttcccatacaaccctgtactgcagtttctagctttccagtgggacttcctgaatgctgccaccttatggtcctctacctggctcagtgtcttctattgtgtgaaaattgctaccttcacccaccctgtcttcttctggctaaagcacaagttgtctgggtggctaccatggatgctcttcagctctgtagggctctccagcttcaccaccattctatttttcataggcaaccacagaatgtatcagaactatttaaggaaccatctacaaccttggaatgtcactggcgatagcatacggagctactgtgagaaattctatctcttccctctaaaaatgattacttggacaatgcccactgctgtctttttcatttgcatgattttgctcatcacatctctgggaagacacaggaagaaggctctccttacaacctcaggattccgagagcccagtgtgcaggcacacataaaggctctgctggctctcctctcttttgccatgctcttcatctcatatttcctgtcactggtgttcagtgctgcaggtatttttccacctctggactttaaattctgggtgtgggagtcagtgatttatctgtgtgcagcagttcaccccatcattctgctcttcagcaactgcaggctgagagctgtgctgaagagtcgtcgttcctcaaggtgtgggacaccttga

SEQ ID NO: 189313 - DNA, 1096 bp, Homo sapiens
  Payload ID: 17386
  Gene Symbol: TAS2R7
  Gene Name: taste receptor, type 2, member 7
  Uniprot ID: Q9NYW3
  ENST ID: ENST00000240687
  CDS Start-End: 58-1014
gcaggtgtggatgtcaaactccatcaggtcaactagaaactaattgcatatttaaacatggcagataaagtgcagactactttattgttcttagcagttggagagttttcagtggggatcttagggaatgcattcattggattggtaaactgcatggactgggtcaagaagaggaaaattgcctccattgatttaatcctcacaagtctggccatatccagaatttgtctattgtgcgtaatactattagattgttttatattggtgctatatccagatgtctatgccactggtaaagaaatgagaatcattgacttcttctggacactaaccaatcatttaagtatctggtttgcaacctgcctcagcatttactatttcttcaagataggtaatttctttcacccacttttcctctggatgaagtggagaattgacagggtgatttcctggattctactggggtgcgtggttctctctgtgtttattagccttccagccactgagaatttgaacgctgatttcaggttttgtgtgaaggcaaagaggaaaacaaacttaacttggagttgcagagtaaataaaactcaacatgcttctaccaagttatttctcaacctggcaacgctgctccccttttgtgtgtgcctaatgtcctttttcctcttgatcctctccctgcggagacatatcaggcgaatgcagctcagtgccacagggtgcagagaccccagcacagaagcccatgtgagagccctgaaagctgtcatttccttccttctcctctttattgcctactatttgtcctttctcattgccacctccagctactttatgccagagacggaattagctgtgatttttggtgagtccatagctctaatctacccctcaagtcattcatttatcctaatactggggaacaataaattaagacatgcatctctaaaggtgatttggaaagtaatgtctattctaaaaggaagaaaattccaacaacataaacaaatctgaagagaaactatgcttttctaggacaaacaaagataagatgtttctaaattaacttcagttcttgcattaatgttttatgtga

SEQ ID NO: 189314 - DNA, 1096 bp, Homo sapiens; identical to SEQ ID NO: 189313
  Payload ID: 17386
  Gene Symbol: TAS2R7
  Gene Name: taste receptor, type 2, member 7
  Uniprot ID: Q9NYW3
  ENST ID: ENST00000574656
  CDS Start-End: 58-1014

SEQ ID NO: 189315 - DNA, 1096 bp, Homo sapiens; identical to SEQ ID NO: 189313
  Payload ID: 17386
  Gene Symbol: TAS2R7
  Gene Name: taste receptor, type 2, member 7
  Uniprot ID: Q9NYW3
  ENST ID: ENST00000613239
  CDS Start-End: 58-1014

SEQ ID NO: 189316 - DNA, 1243 bp, Homo sapiens
  Payload ID: 17387
  Gene Symbol: TAS2R8
  Gene Name: taste receptor, type 2, member 8
  Uniprot ID: Q9NYW2
  ENST ID: ENST00000240615
  CDS Start-End: 314-1243
ctttgaatttgcatgggagcaatttcagccaaacatttcaggtatcactcactaaaggataataattataatttttccaggctataaataactagtcaagctgctcattagttggtttcatcttcaggagtgtagagacaatcctatttcagaggagagctgaacacttccggaagaataacaacgtcgaaataacagcagatgaaaacattattgcatgattcgaagaattgatctatcatgctttaacaggtcacctgtaaattagctcatctacagtgatatttgaaatcagattgttctctctacaaacatgttcagtcctgcagataacatctttataatcctaataactggagaattcatactaggaatattggggaatggatacattgcactagtcaactggattgactggattaagaagaaaaagatttccacagttgactacatccttaccaatttagttatcgccagaatttgtttgatcagtgtaatggttgtaaatggcattgtaatagtactgaacccagatgtttatacaaaaaataaacaacagatagtcatttttaccttctggacatttgccaactacttaaatatgtggattaccacctgccttaatgtcttctattttctgaagatagccagttcctctcatccactttttctctggctgaagtggaaaattgatatggtggtgcactggatcctgctgggatgctttgccatttccttgttggtcagccttatagcagcaatagtactgagttgtgattataggtttcatgcaattgccaaacataaaagaaacattactgaaatgttccatgtgagtaaaataccatactttgaacccttgactctctttaacctgtttgcaattgtcccatttattgtgtcactgatatcatttttccttttagtaagatctttatggagacataccaagcaaataaaactctatgctaccggcagtagagaccccagcacagaagttcatgtgagagccattaaaactatgacttcatttatcttcttttttttcctatactatatttcttctattttgatgacctttagctatcttatgacaaaatacaagttagctgtggagtttggagagattgcagcaattctctaccccttgggtcactcacttattttaattgttttaaataataaactgaggcagacatttgtcagaatgctgacatgtagaaaaattgcctgcatgatatga

SEQ ID NO: 189317 - DNA, 1243 bp, Homo sapiens; identical to SEQ ID NO: 189316
  Payload ID: 17387
  Gene Symbol: TAS2R8
  Gene Name: taste receptor, type 2, member 8
  Uniprot ID: Q9NYW2
  ENST ID: ENST00000572823
  CDS Start-End: 314-1243

SEQ ID NO: 189318 - DNA, 1243 bp, Homo sapiens; identical to SEQ ID NO: 189316
  Payload ID: 17387
  Gene Symbol: TAS2R8
  Gene Name: taste receptor, type 2, member 8
  Uniprot ID: Q9NYW2
  ENST ID: ENST00000610444
  CDS Start-End: 314-1243

SEQ ID NO: 189319 - DNA, 1032 bp, Homo sapiens
  Payload ID: 17388
  Gene Symbol: TAS2R9
  Gene Name: taste receptor, type 2, member 9
  Uniprot ID: Q9NYW1
  ENST ID: ENST00000240691
  CDS Start-End: 94-1032
gtctaagaggcagacagatacattgttcttcactggtcagctgaaagtcaattcatcatcagtgatattcaaaaatcacaagtctttgctggcatgccaagtgcaatagaggcaatatatattattttaattgctggtgaattgaccatagggatttggggaaatggattcattgtactagttaactgcattgactggctcaaaagaagagatatttccttgattgacatcatcctgatcagcttggccatctccagaatctgtctgctgtgtgtaatatcattagatggcttctttatgctgctctttccaggtacatatggcaatagcgtgctagtaagcattgtgaatgttgtctggacatttgccaataattcaagtctctggtttacttcttgcctcagtatcttctatttactcaagatagccaatatatcgcacccatttttcttctggctgaagctaaagatcaacaaggtcatgcttgcgattcttctggggtcctttcttatctctttaattattagtgttccaaagaatgatgatatgtggtatcaccttttcaaagtcagtcatgaagaaaacattacttggaaattcaaagtgagtaaaattccaggtactttcaaacagttaaccctgaacctgggggtgatggttccctttatcctttgcctgatctcatttttcttgttacttttctccctagttagacacaccaagcagattcgactgcatgctacagggttcagagaccccagtacagaggcccacatgagggccataaaggcagtgatcatctttctgctcctcctcatcgtgtactacccagtctttcttgttatgacctctagcgctctgattcctcagggaaaattagtgttgatgattggtgacatagtaactgtcattttcccatcaagccattcattcattctaattatgggaaatagcaagttgagggaagcttttctgaagatgttaagatttgtgaagtgtttccttagaagaagaaagccttttgttccatag

SEQ ID NO: 189320 - DNA, 1032 bp, Homo sapiens; identical to SEQ ID NO: 189319
  Payload ID: 17388
  Gene Symbol: TAS2R9
  Gene Name: taste receptor, type 2, member 9
  Uniprot ID: Q9NYW1
  ENST ID: ENST00000573524
  CDS Start-End: 94-1032

SEQ ID NO: 189321 - DNA, 1032 bp, Homo sapiens; identical to SEQ ID NO: 189319
  Payload ID: 17388
  Gene Symbol: TAS2R9
  Gene Name: taste receptor, type 2, member 9
  Uniprot ID: Q9NYW1
  ENST ID: ENST00000616297
  CDS Start-End: 94-1032

SEQ ID NO: 189322 - DNA, 1861 bp, Homo sapiens
  Payload ID: 17389
  Gene Symbol: TBP
  Gene Name: TATA box binding protein
  Uniprot ID: P20226
  ENST ID: ENST00000230354
  CDS Start-End: 237-1256
ggcaggttcgctgtggcgggcgcctgggccgccggctgtttaacttcgcttccgctggcccatagtgatctttgcagtgacccagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttagattgttgtta

SEQ ID NO: 189323 - DNA, 1903 bp, Homo sapiens
  Payload ID: 17389
  Gene Symbol: TBP
  Gene Name: TATA box binding protein
  Uniprot ID: P20226
  ENST ID: ENST00000392092
  CDS Start-End: 280-1299
ggcggaagtgacattatcaacgcgcgccaggggttcagtgaggtcgggcaggttcgctgtggcgggcgcctgggccgccggctgtttaacttcgcttccgctggcccatagtgatctttgcagtgacccagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttagattgttgtt

SEQ ID NO: 189324 - DNA, 935 bp, Homo sapiens
  Payload ID: 17389
  Gene Symbol: TBP
  Gene Name: TATA box binding protein
  ENST ID: ENST00000421512
  CDS Start-End: 311-935
ggagcaactcgctgaagccgagggcagaactggcggaagtgacattatcaacgcgcgccaggggttcagtgaggtcgggcaggttcgctgtggcgggcgcctgggccgccggctgtttaacttcgcttccgctggcccatagtgatctttgcagtgacccagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaa

SEQ ID NO: 189325 - DNA, 892 bp, Homo sapiens
  Payload ID: 17389
  Gene Symbol: TBP
  Gene Name: TATA box binding protein
  ENST ID: ENST00000446829
  CDS Start-End: 1-304
tgaagaacagtccagactggcagcaagaaaatatgctagagttgtacagaagttgggttttccagctaagttcttggacttcaagattcagaatatggtggggagctgtgatgtgaagtttcctataagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaa

SEQ ID NO: 189326 - DNA, 703 bp, Homo sapiens
  Payload ID: 17389
  Gene Symbol: TBP
  Gene Name: TATA box binding protein
  ENST ID: ENST00000423353
  CDS Start-End: 252-703
gttccggcctgtaacggccactcggccgccactcccgcctggtgccctactctgctgtgtttcgcaggcagcttcccatcgtacgattgtggggctcaggcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcc

SEQ ID NO: 189327 - DNA, 1701 bp, Homo sapiens
  Payload ID: 17389
  Gene Symbol: TBP
  Gene Name: TATA box binding protein
  Uniprot ID: P20226
  ENST ID: ENST00000540980
  CDS Start-End: 138-1097
ggcggaagtgacattatcaacgcgcgccaggggttcagtgaggtcgggcaggttcgctgtggcgggcgcctgggccgccggctgtttaacttcgcttccgctggcccatagtgatctttgcagtgacccagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttagattgttgtt

SEQ ID NO: 189328 - DNA, 1750 bp, Homo sapiens
  Payload ID: 17389
  Gene Symbol: TBP
  Gene Name: TATA box binding protein
  ENST ID: ENST00000616883
  CDS Start-End: 280-1146
ggcggaagtgacattatcaacgcgcgccaggggttcagtgaggtcgggcaggttcgctgtggcgggcgcctgggccgccggctgtttaacttcgcttccgctggcccatagtgatctttgcagtgacccagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttagattgttgtt

SEQ ID NO: 189329 - DNA, 1894 bp, Homo sapiens
  Payload ID: 17390
  Gene Symbol: TAF1A
  Gene Name: TATA box binding protein (TBP)-associated factor, RNA polymerase I, A, 48kDa
  Uniprot ID: Q15573
  ENST ID: ENST00000352967
  CDS Start-End: 190-1542
gccaacgatacgcctgctgcagcaggaggagttacgagccgggccgcgcgctgcctaaatacctaaaccaggtttagcgcctgctcatataaagctctcctaactcgtcttccggtgggaatttcttcacgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggccattggagggaaaaggaggaaggattttgctcagacaacaagtgcttgtttaagttttatccaagaagctctgctgaagcaccaatggcagcaagctgcagaatacatgtacagttattttcagaccttggaagattcagatagctacaaaaggcaggctgcacctgagattatttggaagctcggaagtgaaattctattttatcatcccaaaagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaacaccgtaaactggggttggaggtattatttggagtcttagattttgccggatgcactaagaatataactgcttggaaatacttggcaaaatatctgaaaaatatcttaatgggaaaccaccttgcgtgggttcaagaagagtggaactccaggaaaaactggtggccaggctttcatttcagctacttttgggcaaaaagtgattggaaggaagatacagctttggcctgtgagaaagcttttgtggctggtttactgttaggaaaaggttgtagatatttccggtatattttaaagcaagatcaccaaatcttagggaagaaaattaagcggatgaagagatctgtgaaaaaatacagtattgtaaatccaagactctgatactgaattttagttatttcacagttgtagctacacagtaagtagcttggtagatagttattgaatgtatttatgtagtgtattaagaagcttatattactacaaaaaacttatttttatatatttttatatttttgtattatttatagctagagaaacaatattactgcctttgctctttgtaactatgtctgttttcttttttgtaatgttaaatgttacatttgttaaggaataattcttcaaatgacaaactaattacagaatatagctctacagcagttattgtttgcaaatactttgcctcttgctattgtgtaataaactgtaacttgtagtgctgtgaaatgta

SEQ ID NO: 189330 - DNA, 1966 bp, Homo sapiens
  Payload ID: 17390
  Gene Symbol: TAF1A
  Gene Name: TATA box binding protein (TBP)-associated factor, RNA polymerase I, A, 48kDa
  Uniprot ID: Q15573
  ENST ID: ENST00000350027
  CDS Start-End: 210-1562
acttccggggtcgaggcgaggccaacgatacgcctgctgcagcaggaggagttacgagccgggccgcgcgctgcctaaatacctaaaccaggtttagcgcctgctcatataaagctctcctaactcgtcttccggtgggaatttcttcacgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggccattggagggaaaaggaggaaggattttgctcagacaacaagtgcttgtttaagttttatccaagaagctctgctgaagcaccaatggcagcaagctgcagaatacatgtacagttattttcagaccttggaagattcagatagctacaaaaggcaggctgcacctgagattatttggaagctcggaagtgaaattctattttatcatcccaaaagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaacaccgtaaactggggttggaggtattatttggagtcttagattttgccggatgcactaagaatataactgcttggaaatacttggcaaaatatctgaaaaatatcttaatgggaaaccaccttgcgtgggttcaagaagagtggaactccaggaaaaactggtggccaggctttcatttcagctacttttgggcaaaaagtgattggaaggaagatacagctttggcctgtgagaaagcttttgtggctggtttactgttaggaaaaggttgtagatatttccggtatattttaaagcaagatcaccaaatcttagggaagaaaattaagcggatgaagagatctgtgaaaaaatacagtattgtaaatccaagactctgatactgaattttagttatttcacagttgtagctacacagtataccaccatgaagaaatatattggtgatgagttctattgaggaattttgaaaagagagaaggatttagaaaaaagactctttctcggccgggcgcagtggctcacacttctaatcccagcacttgggaggccgaggtgggtggatcatgaggtcaggagttcaagaccagcctggccaacacagtgaaaccctgtctctactaaaaatacaaaaagtagctgggcgcagtggcgggcatttgtaatcccagatactcgggaggctgaagcaggagaattgcttgaacccgggaggtggaggttgcagtgagccgagattgcaccaccgtactcctgcctgggcgacagaactagactctgtctc

SEQ ID NO: 189331 - DNA, 1648 bp, Homo sapiens
  Payload ID: 17390
  Gene Symbol: TAF1A
  Gene Name: TATA box binding protein (TBP)-associated factor, RNA polymerase I, A, 48kDa
  Uniprot ID: Q15573
  ENST ID: ENST00000366890
  CDS Start-End: 234-1244
acgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggattatttggaagctcggaagtgaaattctattttatcatcccaaaagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaacaccgtaaactggggttggaggtattatttggagtcttagattttgccggatgcactaagaatataactgcttggaaatacttggcaaaatatctgaaaaatatcttaatgggaaaccaccttgcgtgggttcaagaagagtggaactccaggaaaaactggtggccaggctttcatttcagctacttttgggcaaaaagtgattggaaggaagatacagctttggcctgtgagaaagcttttgtggctggtttactgttaggaaaaggttgtagatatttccggtatattttaaagcaagatcaccaaatcttagggaagaaaattaagcggatgaagagatctgtgaaaaaatacagtattgtaaatccaagactctgatactgaattttagttatttcacagttgtagctacacagtataccaccatgaagaaatatattggtgatgagttctattgaggaattttgaaaagagagaaggatttagaaaaaagactctttctcggccgggcgcagtggctcacacttctaatcccagcacttgggaggccgaggtgggtggatcatgaggtcaggagttcaagaccagcctggccaacacagtgaaaccctgtctctactaaaaatacaaaaagtagctgggcgcagtggcgggcatttgtaatcccagatactcgggaggctgaagcaggagaattgcttgaacccgggaggtggaggttgcagtgagccgagattgcaccaccgtactcctgcctgggcgacagaactagactctgtctc

SEQ ID NO: 189332 - DNA, 894 bp, Homo sapiens
  Payload ID: 17390
  Gene Symbol: TAF1A
  Gene Name: TATA box binding protein (TBP)-associated factor, RNA polymerase I, A, 48kDa
  ENST ID: ENST00000391883
  CDS Start-End: 36-894
ttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggccattggagggaaaaggaggaaggattttgctcagacaacaagtgcttgtttaagttttatccaagaagctctgctgaagcaccaatggcagcaagctgcagaatacatgtacagttattttcagaccttggaagattcagatagctacaaaaggcaggctgcacctgagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaac

SEQ ID NO: 189333 - DNA, 2387 bp, Homo sapiens
  Payload ID: 17391
  Gene Symbol: TAF1B
  Gene Name: TATA box binding protein (TBP)-associated factor, RNA polymerase I, B, 63kDa
  Uniprot ID: Q53T94
  ENST ID: ENST00000263663
  CDS Start-End: 189-1955
gtccgcgaggggtctgcgagctttgcggagcctcgcccccgagcgcgcggtttccctgccgcgcaggcgcacggaatcctaggcgcggatctcgcgtttccggccggaagcttctccagcctttcccggaagctgcgctcgctacccgggtaacgggtcccggctgtggaagctcccgcggcgccgcgatggacctcgaggaggcggaagagtttaaagaacgctgtactcagtgtgctgctgtctcatggggtcttactgatgaaggcaaatattattgcacttcttgccacaatgttacagagagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaagaacgatgttttacataatttttggaagcgctaccttcagaagagcaagcaggcatattgtaagaacccagtttataccactggaaggaaacctacggtattagaagataatctaagtcattcagactgggctagtgagcctgagctgctaagtgatgtcagctgtcctccttttcttgaaagtggagcggagtctcagtctgacatccacactcgaaaacctttccccgtcagcaaagcatcacaatcagaaacgtctgtctgctctggatctctggatggagttgaatactcacaacgaaaggagaagggaatcgtgaagatgaccatgccacagacacttgccttctgttatctgtccttactttggcagagagaagcaataacactttcagatcttttgaggtttgttgaagaggaccatattccttacataaatgcttttcagcattttccagaacagatgaaattatatggacgtgacagaggaatctttggtatagagtcttggcctgactacgaggacatctacaaaaaaacagtagaagttggaacatttttagatttgcctcgttttccagacataactgaagactgctatcttcatcccaacatactgtgtatgaaatacttgatggaagtcaacctccctgatgaaatgcatagcttaacttgccacgtggtaaaaatgactggaatgggagaagtggattttctgacatttgatcctatagctaaaatggcaaaaactgttaagtacgatgtacaagctgtagctatcattgtggtggtattgaaactgctctttctattggatgacagtttcgagtggtctttgtctaatcttgctgaaaagcataatgaaaagaacaaaaaagataagccatggtttgatttcagaaagtggtaccaaattatgaagaaagcttttgatgagaaaaaacaaaaatgggaagaagcaagggccaagtacctgtggaaaagtgaaaagccactctactactcatttgtcgacaaaccagtagcatataaaaaaagagaaatggtggtgaatctacagaaacaatttagcacactggtcgagtcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatgctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaagaaagaaatcaagatccaagaaagtgagacgacattgagaaaatgaaatagaaactttctggaaaaatattttaatagtgataataacatcagattttaatataacattccagagaattgtggaaaatactgcatatatatgtatagactctgacacatatttacatatatatcaagtgtgcttagaaaaatgtatattgtaaagcaggtgagcttcatttgattttatttttcagagtatgaacattctaagagaaagttaaaacaatagcaaattgtataattgtatccagaaatgtatactcatcgtattttaaagctaaatttattttttaaactagatcccttcattattctttatgccccagagtaaatcccagatggatcaaagatctaaacataatctttcatatgtaaaaatataaaagtattagtagaaaacaaatatgaatgctttgatgatcttggaa

SEQ ID NO: 189334 - DNA, 297 bp, Homo sapiens
  Payload ID: 17391
  Gene Symbol: TAF1B
  Gene Name: TATA box binding protein (TBP)-associated factor, RNA polymerase I, B, 63kDa
  ENST ID: ENST00000416181
  CDS Start-End: 16-189
tcccgcggcgccgcgatggacctcgaggaggcggaagagtttaaagaacgctgtactcagtgtgctgctgtctcatggggtcttactgatgaaggcaaatattattgcacttcttgccacaatgttacagagtaccttacagattacaaagtttttggatccattatctcatttcctcctcatcactaactgtgagagcctattgatagggctcagaagttgagtgagtttgccaaagttacccaagtaccaggacttgaatagatatcaggaagttacaaacactgatcttattcc

SEQ ID NO: 189335 - DNA, 1592 bp, Homo sapiens
  Payload ID: 17391
  Gene Symbol: TAF1B
  Gene Name: TATA box binding protein (TBP)-associated factor, RNA polymerase I, B, 63kDa
  ENST ID: ENST00000434858
  CDS Start-End: 18-602
gctcccgcggcgccgcgatggacctcgaggaggcggaagagtttaaagaacgctgtactcagtgtgctgctgtctcatggggtcttactgatgaaggcaaatattattgcacttcttgccacaatgttacagagagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaagaacgatgttttacataatttttggaagcgctaccttcagaagagcaagcaggcatattgtaagaacccagtttataccactggaaggaaacctacggtattagaagataatctaagtcattcagactgggctagtgagcctgagctgctaagtgatgtcagctgtcctccttttcttgaaagtggagcggagtctcagtctgacatccacactcgaaaacctttccccgtcagcaaagcatcacaatcaggtttgttgaagaggaccatattccttacataaatgcttttcagcattttccagaacagatgaaattatatggacgtgacagaggaatctttggtatagagtcttggcctgactacgaggacatctacaaaaaaacagtagaagttggaacatttttagatttgcctcgttttccagacataactgaagactgctatcttcatcccaacatactgtgtatgaaatacttgatggaagtcaacctccctgatgaaatgcatagcttaacttgccacgtggtaaaaatgactggaatgggagaagtggattttctgacatttgatcctatagctaaaatggcaaaaactgttaagtacgatgtacaagctgtagctatcattgtggtggtattgaaactgctctttctattggatgacagtttcgagtggtctttgtctaatcttgctgaaaagcataatgaaaagaacaaaaaagataagccatggtttgatttcagaaagtggtaccaaattatgaagaaagcttttgatgagaaaaaacaaaaatgggaagaagcaagggccaagtacctgtggaaaagtgaaaagccactctactactcatttgtcgacaaaccagtagcatataaaaaaagagaaatggtggtgaatctacagaaacaatttagcacactggtcgagtcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatgctattgtacacatgtgacaacctatgaagaatcaaattattctctgagttatcagtttatactaaatctcttctccttcctgctcagaataaagacttcccttctccatgaagaagtgagcttagttgagaagaaactttttgagaaaaaatacagtgtaaaaa

SEQ ID NO: 189336 - DNA, 1045 bp, Homo sapiens
  Payload ID: 17391
  Gene Symbol: TAF1B
  Gene Name: TATA box binding protein (TBP)-associated factor, RNA polymerase I, B, 63kDa
  ENST ID: ENST00000492648
  CDS Start-End: 1-649
aacactttcagatcttttgaggtttgttgaagaggaccatattccttacataaatgcttttcagcattttccagaacagatgaaattatatggacgtgacagaggaatctttggtatagagtcttggcctgactacgaggacatctacaaaaaaacagtagaagttggaacatttttagatttgcctcgttttccagacataactgaagactgctatcttcatcccaacatactgtgtatgaaatacttgatggaagtcaacctccctgatgaaatgcatagcttaacttgccacgtggtaaaaatgactggaatgggagaagtggattttctgacatttgatcctatagctaaaatggcaaaaactgttaagtacgatgtacaagctgtagctatcattgtggtggtattgaaactgctctttctattggatgacagtttcgagtggtctttgtctaatcttgctgaaaagcataatgaaaagaacaaaaaagataagccatggtttgatttcagaaagtggtaccaaattatgaagaaagcttttgatgagaaaaaacaaaaatgggaagaagcaagggccaagtatgttctccttcctggtttagatgcacctgccttacttctgtgtctgttactttacatttgaaagctgaagcttcatcagtatacacttatctacattgtgacttttttttctggaaatattagccctacactctaattaacttttctcttttttacattactattaatcaaagtttagatttgatgtggatttcaccagtgtttttattaatgtcctctttctgttccatgatccaatgcaggataccacagtatactttttataatttaactttttataatttgcatgagacttgcctatatttctaatactcctccctcttcccctttctcaaatttagtcatttctcatctatgcttcccaatattaaaaagattacaaatgttaccttgcaacatatgtaattggaatgttcccccaaaataaagatccctgtgaaaattaaaacaaaggaaa

SEQ ID NO: 189337 - DNA, 273 bp, Homo sapiens
  Payload ID: 17391
  Gene Symbol: TAF1B
  Gene Name: TATA box binding protein (TBP)-associated factor, RNA polymerase I, B, 63kDa
  ENST ID: ENST00000625239
  CDS Start-End: 100-273
tctcgcgtttccggccggaagcttctccagcctttcccggaagctgcgctcgctacccgggtaacgggtcccggctgtggaagctcccgcggcgccgcgatggacctcgaggaggcggaagagtttaaagaacgctgtactcagtgtgctgctgtctcatggggtcttactgatgaaggcaaatattattgcacttcttgccacaatgttacagagtaccttacagattacaaagtttttggatccattatctcatttcctcctcatcactaa

SEQ ID NO: 189338 - DNA, 3678 bp, Homo sapiens
  Payload ID: 17392
  Gene Symbol: TAF1C
  Gene Name: TATA box binding protein (TBP)-associated factor, RNA polymerase I, C, 110kDa
  Uniprot ID: Q15572
  ENST ID: ENST00000341690
  CDS Start-End: 262-2589
ccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccttggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttatgattaaaccatttatgctacatataa

SEQ ID NO: 189339 - DNA, 3502 bp, Homo sapiens
  Payload ID: 17392
  Gene Symbol: TAF1C
  Gene Name: TATA box binding protein (TBP)-associated factor, RNA polymerase I, C, 110kDa
  Uniprot ID: Q15572
  ENST ID: ENST00000541676
  CDS Start-End: 795-2408
aggaggcacttccggtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggagaatttcaagctggagggagcgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccttggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttatgattaaaccatttatgctacatataactggg

SEQ ID NO: 189340 - DNA, 555 bp, Homo sapiens
  Payload ID: 17392
  Gene Symbol: TAF1C
  Gene Name: TATA box binding protein (TBP)-associated factor, RNA polymerase I, C, 110kDa
  ENST ID: ENST00000569609
  CDS Start-End: 218-376
aagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacgaactctggcgccccttaccagcttccagtctctcgaggtggccagtgtggtgcttggtccttgtttccaggatggacttccccagctccctccgccctgcattgtttctgaccggcccccttggtctgagcgacgtccctgacctctctttcatgtgcagctggcgagacgcactgactctgccagaggcccagccccagaactcagagatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaag

SEQ ID NO: 189341 - DNA, 602 bp, Homo sapiens
  Payload ID: 17392
  Gene Symbol: TAF1C
  Gene Name: TATA box binding protein (TBP)-associated factor, RNA polymerase I, C, 110kDa
  ENST ID: ENST00000564345
  CDS Start-End: 165-602
acttccggtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacgatggacttccccagctccctccgccctgcattgtttctgaccggcccccttggtctgagcgacgtccctgacctctctttcatgtgcagctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagt

SEQ ID NO: 189342 - DNA, 2349 bp, Homo sapiens
  Payload ID: 17392
  Gene Symbol: TAF1C
  Gene Name: TATA box binding protein (TBP)-associated factor, RNA polymerase I, C, 110kDa
  Uniprot ID: Q15572
  ENST ID: ENST00000570117
  CDS Start-End: 643-2256
ggtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacctggcgagacgcactgactctgccagaggcccagccccagaactcagaggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcag

SEQ ID NO: 189343 - DNA, 3879 bp, Homo sapiens
  Payload ID: 17392
  Gene Symbol: TAF1C
  Gene Name: TATA box binding protein (TBP)-associated factor, RNA polymerase I, C, 110kDa
  Uniprot ID: Q15572
  ENST ID: ENST00000567759
  CDS Start-End: 184-2793
cccgagtgccaaagctggggttctacttgagatttccctcgtggtgccagggtccggcgagcatcacgccgaggcccattttccagacgaccacgacgaggccggggtcacgaactctggcgccccttaccagcttccagtctctcgaggtggccagtgtggtgcttggtccttgtttccaggatggacttccccagctccctccgccctgcattgtttctgaccggcccccttggtctgagcgacgtccctgacctctctttcatgtgcagctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaagtaaggcccttatatacactttcctccctcactggctgacctgctacctgacccctggccctttccatccctcctcagctctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccttggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttatgattaaaccatttatgctacata

SEQ ID NO: 189344 - DNA, 2531 bp, Homo sapiens
  Payload ID: 17392
  Gene Symbol: TAF1C
  Gene Name: TATA box binding protein (TBP)-associated factor, RNA polymerase I, C, 110kDa
  ENST ID: ENST00000563428
  CDS Start-End: 289-465
agctgcggcggggctgacccgtcccgagtgccaaagctggggttctacttgagatttccctcgtggtgccagggtccggcgagcatcacgccgaggcccattttccagacgaccacgacgaggccggggtcacatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggagaatttcaagctggagggagcgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggaca

SEQ ID NO: 189345 - DNA, 2972 bp, Homo sapiens
  Payload ID: 17392
  Gene Symbol: TAF1C
  Gene Name: TATA box binding protein (TBP)-associated factor, RNA polymerase I, C, 110kDa
  Uniprot ID: Q15572
  ENST ID: ENST00000566732
  CDS Start-End: 212-2743
gtgggtagctgcggcggggctgacccgtcccgagtgccaaagctggggttctacttgagatttccctcgtggtgccagggtccggcgagcatcacgccgaggcccattttccagacgaccacgacgaggccggggtcacgaactctggcgccccttaccagcttccagtctctcgaggtggccagtgtggtgcttggtccttgtttccaggatggacttccccagctccctccgccctgcattgtttctgaccggcccccttggtctgagcgacgtccctgacctctctttcatgtgcagctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggca

SEQ ID NO: 189346 - DNA, 570 bp, Homo sapiens
  Payload ID: 17392
  Gene Symbol: TAF1C
  Gene Name: TATA box binding protein (TBP)-associated factor, RNA polymerase I, C, 110kDa
  ENST ID: ENST00000561955
  CDS Start-End: 290-570
gtgggtagctgcggcggggctgacccgtcccgagtgccaaagctggggttctacttgagatttccctcgtggtgccagggtccggcgagcatcacgccgaggcccattttccagacgaccacgacgaggccggggtcacatccctgggaccctggcctgactgcccgggacctgcttttccgcggagggtgccggtatcggaagcggccccgagtcgtgctggatgtgactgagcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggt

SEQ ID NO: 189347 - DNA, 1140 bp, Homo sapiens
  Payload ID: 17392
  Gene Symbol: TAF1C
  Gene Name: TATA box binding protein (TBP)-associated factor, RNA polymerase I, C, 110kDa
  ENST ID: ENST00000568265
  CDS Start-End: 1-1140
ctcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcaga

SEQ ID NO: 189348 - DNA, 2628 bp, Homo sapiens
  Payload ID: 17392
  Gene Symbol: TAF1C
  Gene Name: TATA box binding protein (TBP)-associated factor, RNA polymerase I, C, 110kDa
  ENST ID: ENST00000566903
  CDS Start-End: 154-783
gatttccctcgtggtgccagggtccggcgagcatcacgccgaggcccattttccagacgaccacgacgaggccggggtcacgaactctggcgccccttaccagcttccagtctctcgaggtggccagtgtggtgcttggtccttgtttccaggatggacttccccagctccctccgccctgcattgtttctgaccggcccccttggtctgagcgacgtccctgacctctctttcatgtgcagctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggcaagtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccttggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttatg

SEQ ID NO: 189349 - DNA, 564 bp, Homo sapiens
  Payload ID: 17392
  Gene Symbol: TAF1C
  Gene Name: TATA box binding protein (TBP)-associated factor, RNA polymerase I, C, 110kDa
  ENST ID: ENST00000569505
  CDS Start-End: 184-396
ctgacccgtcccgagtgccaaagctggggttctacttgagatttccctcgtggtgccagggtccggcgagcatcacgccgaggcccattttccagacgaccacgacgaggccggggtcacaatggggcactgcatgtgaccaaggacctgctgtgggagccggcaacccctgggcctctccccatgctgcctcccctcatcgatccctgggaccctggcctgactgcccgggacctgcttttccgcggagggtgccggtatcggaagcggccccgagtcgtgctggatgtgactgagcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacga

SEQ ID NO: 189350 - DNA, 555 bp, Homo sapiens
  Payload ID: 17392
  Gene Symbol: TAF1C
  Gene Name: TATA box binding protein (TBP)-associated factor, RNA polymerase I, C, 110kDa
  ENST ID: ENST00000564454
  CDS Start-End: 147-555
aagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacgatggacttccccagctccctccgccctgcattgtttctgaccggcccccttggtctgagcgacgtccctgacctctctttcatgtgcagctggcgagacgcactgactctgccagaggcccagccccagaactcagagaatggggcactgcatgtgaccaaggacctgctgtgggagccggcaacccctgggcctctccccatgctgcctcccctcatcgccctttccgtaacctccttctcagatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggaga

SEQ ID NO: 189351 - DNA, 2540 bp, Homo sapiens
  Payload ID: 17393
  Gene Symbol: TAF1D
  Gene Name: TATA box binding protein (TBP)-associated factor, RNA polymerase I, D, 41kDa
  Uniprot ID: Q9H5J8
  ENST ID: ENST00000323981
  CDS Start-End: 201-1037
cttttcttccgcacggttggaggaggtcggctggttatcgggagttggagggctgaggtcgggagggtggtgtgtacagagctctaggacaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatggcaagtaatggtttttatcttaactataagttatttgctcaagggtgtaatggtcattaccaaggcttttagaatgcagtttctcatttgctgtggacatgaccataaaaaaatttcccagtaggttttctatctgctactttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccatagcactcctaatgtttggtgctatgttttcctgaggagatataaaacgtaataatccaggattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcagttgtgtacttcatgcttgaaaaattaagtccttctccctcagttatactcaccttatggaattcttttgcccttgctctgttttgggcataagcttcttgttttgttttttcttccttttgttgtttcacttcagctagttgattgtataacctgtaaagaatttatatagaattagagacaaacactgcaaaaagtgaatcactaaaaaaaaaaaaaaaattaaccctaccttagacccctttggtgcctta

SEQ ID NO: 189352 - DNA, 547 bp, Homo sapiens
  Payload ID: 17393
  Gene Symbol: TAF1D
  Gene Name: TATA box binding protein (TBP)-associated factor, RNA polymerase I, D, 41kDa
  ENST ID: ENST00000393259
  CDS Start-End: 1-135
gaggatgcaacacatcttgaagataacgaatgtgatatcaaattggcaggggatagtttcatagcttttatcttgagaacatggtgtctggagttaaaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacacta

SEQ ID NO: 189353 - DNA, 2082 bp, Homo sapiens
  Payload ID: 17393
  Gene Symbol: TAF1D
  Gene Name: TATA box binding protein (TBP)-associated factor, RNA polymerase I, D, 41kDa
  Uniprot ID: Q9H5J8
  ENST ID: ENST00000448108
  CDS Start-End: 652-1488
caaaggattacaaaacactcaggcacacatcccacccgtcaccctcgccacacacccgggaccagatttagaaagccaggcgacagctcagcaaacgcgagaccaccggaaacgaaccgggctgagaggctgtttcctcacagttctcatccactcacaagtgaccgcacgttttgtttttgttatttgccgaaatgttcttggctattccactcacctaaacggtcacggtagcaaaacacccagagtccggatcttcgcctaggccaaccccgcctcctcagaatacgcgagctagagctccgcccacgttagtcagtcctccctgcgcggcgagaaaaatggcgcccccacgtcgcgtctcctcccaccgctcgccttcttcccggaagctaagttgtatcgcgagatttcggcctgactattacttgggccacggaaatagccaacccttttcttccgcacggttggaggaggtcggctggttatcgggagttggagggctgaggtcgggagggtggtgtgtacagagctctaggacaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggtgaagcatatagaaaaaacgacttcatagaaatgaataaagataaatgtggatatatgtaccagtctggtggtgaagaaattctgaaacccagaactttataacaagaaaaaaaatttttaaccctgtgaagaagtttgtgaaagaaacttgtgaagtagtaataattagaaaaaaaaccattaaaacaccagagaaaatacatagaaaaatttgagaaattgtcatttgatttctgaataagagcttacaggtgtcctgtgagtattgaaacaatgaaatgtagtgattttaattttgaaaagaaaatcttaaagtaacttgacacccaaccatcttgaagaggggatttgaaatgctgtaattttatcccagctttgttcagccatgacaagtgacctgtcagatgcttagtattgtaataacctcatttccctttccaaatttagagtatctttaatactattttttttagacagagtctcgatctgtcacccaggctgtagtgcaatggccgcagtcttggcttactgcaacctccatctcccgggttcaagcgattctgcctcagcct

SEQ ID NO: 189354 - DNA, 565 bp, Homo sapiens
  Payload ID: 17393
  Gene Symbol: TAF1D
  Gene Name: TATA box binding protein (TBP)-associated factor, RNA polymerase I, D, 41kDa
  ENST ID: ENST00000532455
  CDS Start-End: 1-332
ccttttcttccgcacggttggaggaggtcggctggttatcgggagttggagggctgaggtcgggagggtggtgtgtacagagctctaggacaccaggccagtcgcgggttttgggccgaggcctgggttacaagcagcaagtgcgcggttggggccactgcgaggccgttttagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgag

SEQ ID NO: 189355 - DNA, 335 bp, Homo sapiens
  Payload ID: 17393
  Gene Symbol: TAF1D
  Gene Name: TATA box binding protein (TBP)-associated factor, RNA polymerase I, D, 41kDa
  ENST ID: ENST00000527690
  CDS Start-End: 312-335
cctcgggaaaccgaacgcaacgctcagactggaaacaaaggagctggcccagcaactttcccagaacgcaccgcaagctccctcctcgggacgctgcattttcattttgcattgagcctcacaaattacacagctaggcttgctgctgaatacggcagtgagggacatgccataccagtcctggagcttcgtcattgcccagaccctgtggatcaaatgcagtgggctgcctaaaggatcggactttttatccccggaattgtccaaactatggagcaaagcagaaaactgtttaaaacaaagagcaattgatggataaatcaggaatagattct

SEQ ID NO: 189356 - DNA, 1127 bp, Homo sapiens
  Payload ID: 17393
  Gene Symbol: TAF1D
  Gene Name: TATA box binding protein (TBP)-associated factor, RNA polymerase I, D, 41kDa
  ENST ID: ENST00000527169
  CDS Start-End: 186-833
gttggaggaggtcggctggttatcgggagttggagggctgaggtcgggagggtggtgtgtacagagctctaggacaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacgcttttatcttgagaacatggtgtctggagttaaaggtattggcatactccacacatctgtaccattcttgagtgatcgcttaggaatgaatgtgatttgaactcattcatgttgagagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatggcaa

SEQ ID NO: 189357 - DNA, 1735 bp, Homo sapiens
  Payload ID: 17393
  Gene Symbol: TAF1D
  Gene Name: TATA box binding protein (TBP)-associated factor, RNA polymerase I, D, 41kDa
  Uniprot ID: Q9H5J8
  ENST ID: ENST00000526015
  CDS Start-End: 200-1036
ttttcttccgcacggttggaggaggtcggctggttatcgggagttggagggctgaggtcgggagggtggtgtgtacagagctctaggacaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaagtgataactcttctgatagcagcttatttaaaactcagtgtatcccttactcacctaaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggatccatttctcctattgaggagtcaacagcagaggatgaggatgcaacacatcttgaagataacgaatgtgatatcaaattggcaggggatagtttcatagtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggactattgttagatctgtgggaaggaattacaagacagttgctaaaagtttgaaaaagacggttgctaaacgttatgaaaaaccagataatctacttttttaccttaggtattggcatactccacacatctgtaccattcttgagtgatcgcttaggaatgaatgtgatttgaactcattcatgttgagagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcagttgtgta

SEQ ID NO: 189358 - DNA, 737 bp, Homo sapiens
  Payload ID: 17393
  Gene Symbol: TAF1D
  Gene Name: TATA box binding protein (TBP)-associated factor, RNA polymerase I, D, 41kDa
  ENST ID: ENST00000534770
  CDS Start-End: 187-297
ggttggaggaggtcggctggttatcgggagttggagggctgaggtcgggagggtggtgtgtacagagctctaggacaccaggccagtcgcgggttttgggccgaggcctgggttacaagcagcaagtgcgcggttggggccactgcgaggccgttttagaaaactgtttaaaacaaagagcaattgatggataaatcaggaatagattctcttgaccatgtgacatctgatgctgtggaacttgcaaatcgaaggggagaaaagaaaccccattcgaaaatttgttcgtacacctgaaagtgttcacgcaagtgattcatcaagtgactcatcttttgaaccaataccattgactataaaagctatttttgaaagattcaagaacaggaaaaagagatataaaaaaaagaaaaagaggaggtaccagccaacaggaagaccacggggaagaccagaaggaaggagaaatcctatatactcactaatagataagaagaaacaatttagaagcagaggatctggcttcccatttttagaatcagagaatgaaaaaaacgcaccttggagaaaaattttaacgtttgagcaagctgttgcaagaggattttttaactatattgaaaaactgaagtatgaacaccacctgaaagaatcattgaagcaaatgaatgttggtgaagatttagaaaatgaagattttgacagtcgtagatacaaatttttggatgatgatggat

SEQ ID NO: 189359 - DNA, 483 bp, Homo sapiens
  Payload ID: 17393
  Gene Symbol: TAF1D
  Gene Name: TATA box binding protein (TBP)-associated factor, RNA polymerase I, D, 41kDa
  ENST ID: ENST00000540232
  CDS Start-End: 1-129
gtaagttctgaattccctgtaagactgagtgtatacttagaagaagaggatattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggaatgaatgtgatttgaactcattcatgttgagagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcatta

SEQ ID NO: 189360 - DNA, 505 bp, Homo sapiens
  Payload ID: 17393
  Gene Symbol: TAF1D
  Gene Name: TATA box binding protein (TBP)-associated factor, RNA polymerase I, D, 41kDa
  ENST ID: ENST00000533794
  CDS Start-End: 1-79
tattactgaagaagctgctttgtctaaaaagagagctacaaaagccaaaaatactggacagagaggcctgaaaatgtgacaggatcatgaatgtcaaaggcttttatcttgagaacatggtgtctggagttaaaggtattggcatactccacacatctgtaccattcttgagtgatcgcttaggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaatta

SEQ ID NO: 189361 - DNA, 2037 bp, Homo sapiens
  Payload ID: 17394
  Gene Symbol: TBPL2
  Gene Name: TATA box binding protein like 2
  Uniprot ID: Q6SJ96
  ENST ID: ENST00000247219
  CDS Start-End: 72-1199
acgcttctctcgcgccctctgcaggaacctgggccgagggccgccccgcctcgctgcccccaggctcataaatggcctctgcgccctggccggagcgggttccgaggctgctcgctccgcgcttaccctcttacccgcccccacccccaacagtgggattacggtccatggagcaggaggagacctacctggagctctacctggaccagtgcgccgctcaggatggccttgccccacccaggtctcccctgttcagcccagttgtaccttatgatatgtacatactgaatgcatccaatccggatactgcatttaattcgaaccctgaagtcaaagaaacatctggtgatttctcatctgtggatcttagcttcctaccagatgaagttacccaggaaaataaagaccagcctgtcattagcaaacacgaaactgaagaaaattctgaaagccaaagtccacaaagtaggttgccatcacccagcgaacaggacgttgggctgggcttaaacagcagcagtttgtcaaattcccattcacagctgcaccctggtgatactgactcagtccagccctctcctgagaaaccaaactccgactccttgtctctggcatccataactcccatgacaccaatgacccctatttcagaatgttgtggaattgtacctcaactacagaatatagtttccactgtaaacctggcctgtaagttggatctgaagaaaatagctttgcatgcaaaaaatgcagaatataacccaaagaggtttgctgctgtcataatgaggatccgagagcccaggacaacagcccttatatttagctctgggaagatggtctgcacgggagccaaaagtgaagagcagtctcgacttgcagcaagaaaatatgctcgtgtggtgcagaagcttgggttccctgccagattcctcgattttaaaattcagaacatggttggaagctgtgatgtgagatttcccatcaggctggaaggtttggtgctaacccatcagcagttcagtagttacgagcctgaactgtttcctggtcttatttatagaatggtaaaaccacgaattgtgttgcttatctttgtatctggaaaagttgtgttgacaggtgccaaagaacgttctgagatctatgaagcatttgaaaacatctatcctattctaaaaggttttaaaaaagcctgagcatatcattcagcatctcacattattctggtttgaatatgtccataagcccagcacagaaacagctggattcttctacgtttaattgtagatgttacaagtacgttacttattaaagggcgactctgtgtaagtaacctaagaaacgaagaaaaattcttattcaaaatgactccttttgtgttattttaaaaactgaacaagtaaacatttcaaaatttgagagatttagggtctcactagaatgatattgtagcatcatgaagactcaatgcgtttccttttagccggaagggccatcttccagtaatttgccaaaatgacgaacacaaagggaaagaggtgaggcacctgatacatgttctctaggccttttagaaaagatggagttgttcctttggccacatacatgcgaatctacgaaaaaggtgatattgtagacatcaagggaatggctgcttttcaaaaaggagtgctccgcaaatgttaccacagcaaagctggaagagtctacagtgttacccagcatgctgttggcattgtaaacaagggcaagatttttgccaagagaatgaatgtgcttactgagccaggctggtcttgaactcctgacctcagttgatccatctgcctgggccttggcactctaagagccaagtaagtttcctgaaacgcgtgaaggtaaataatcagaaaaagacgtcaaagggagaggtgtctgagttcaactgaagcgccagcctgctccacccagacaagcacttagaaccaatggagggagcctgggctgctggaacctattccctatgagttcatggcataataggtgtcaaaaaaa

SEQ ID NO: 189362 - DNA, 559 bp, Homo sapiens
  Payload ID: 17394
  Gene Symbol: TBPL2
  Gene Name: TATA box binding protein like 2
  ENST ID: ENST00000556755
  CDS Start-End: 493-559
cttcccggccgccatcccatctaggaagtgaggagtgtctctgcccggccgcccatcgtctgagatgtggggagcgcctctgccccgccgcccgtctgggatgtgaggagcgcctctacgcggccgcgaccccatccaggaggtgaggagcgtctctgcccggccgccccgtctgagaagtgaggagaccctccgcccggcagccgccccgtctgagaagtgaggagcccctccgcccggcagccgccccgtctgagaatgggattacggtccatggagcaggaggagacctacctggagctctacctggaccagtgcgccgctcaggtgggagaatttttttataaagacaatgatcagcactgaggtagaaatggtgactttccctagcatttaacacagcaaagaagagcccagacaggaaaggttctgagaaaggatggccttgccccacccaggtctcccctgttcagcccagttgtaccttatgatatgtacatactgaatgcatccaatccggatactgcatttaattcgaaccctgaagtcaaagaaacat

SEQ ID NO: 189363 - DNA, 6849 bp, Homo sapiens
  Payload ID: 17395
  Gene Symbol: TMF1
  Gene Name: TATA element modulatory factor 1
  Uniprot ID: P82094
  ENST ID: ENST00000398559
  CDS Start-End: 218-3499
gcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttccacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacagctagaaattggcaatctagaaaaaactcgatcaataatggctgaagaactagttaaattaacaaatcaaaatgatgaacttgaagagaaggtgaaggagatacccaaacttagaactcagctaagagatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgggatttactgtagagtgtaaaaatttttttaaaattgttttacactatgtagtaatatttacagttaaattattttgtgcaatatttgaactttatttttgaaactattctttaaagatttattttttaaagcattcattttttttccttgaatagcacagagatttattactttatcctcatataaatatggctagagaagaagaatggtgttcatatatgtattgtagatatacaactagttgtatctataatttgtaagtgtttatatatatattaagaacatttgaagagtaatgttaacatactgaaactttgaaatctttcacatttaaaatttcaacatatcttaattactgctcatgaaaatgtacattaagtgttaaagtaaaaaattattaaatctgtggctattaaattttaaactaatttttttcctttaaaagtaagagtcacactgacactgtctgaaatttaaagagtgaatgatttaaacttaaaaaaaattttgatctgaaaatttatttcacccagctttcacaattaagtctgtataaaatgtggtaccttttggtacctatccagagaaacctgtacatattcaatgttatctagatgtgattggataatggagaaaatttatttataatgattttgcaatggcatcaataacatttaaatgattttgaagaagtattattttactaccctataaaatgaatcgaaaataataaagttcttaacataatttactctttaaaaattacctgttcatattttgtaaacccatatttttagcacattaaaaatgaatgtttgatattacagaatattcataacaaaatggaagaattataggaattaacttgaatttggcatttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaaccccatctctactaaaaatacaaaaattagcctggcgtggtggtgtgcgcctgtaatcctagctactcgggaggctgaggcaggagcattgcttgaacctgggaggtggaggttacaatgagccaagattgtgccactgcactccagcatgggtgacagagaaagactccgtctcaaaaaaaaaaaaacaaactcttatttaatttttagttaaaattaaaacactagtacttcagaatatagatacaagtacaccatcttgaagaatttggagtttttcagggcaattcaaatgacctcattttttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataactgcaaatagaacaattataacagtgcactgtaataaaagtgatgtaaatgtgatatgtctgtctctttctctcaaaatatcttattgtactgtactcacctgtaatcagactgtggttgaccgtgagtaaccgaaaccacagaaagcaaaatcgtggataaggggagactactctatatgaaacttaagttacaaaattctctgaagcatttgaaactagacgttttggaattataaaatagtccctttaaaatatccactagtagaaaaaaacttcatttgcagagaaaagattgcaataaaactcattcctaaacttttcaattttataaaattaaacattctttttttatccgtattaacaatttctagttacatagtttctagttacatattaccatatattactctttatctacaaataaatagctgatactcaaactgatcatattttgattgttaaacacttggatctctcaatacttctgtaagttaaagtgaacttaaacagtttcttgaaaaactccagtaggtggcagaatacctattgaatattcgttgctatactttgctgtttgtcattaaaacatctctacccatattcttgcaaaataatatttatattttaatggataggaaaatgatttgcaattagatgtttccattcttgaaagaaaaaagctgcaaataacattttcaagaatataaaaaaatgagtaaacaaagggaaggttgtttggtcatttatagacaattaagcacagactgtagatgtccttccaattcttgggaggctaaactgagtctaccatttcttacatttcttttacctattttttgagaattgccagttgtacagtgtttagcatgtggaatgtaccaaatatatctatgttgtgacttaagatattctaaatgtggataacttctgacctaggaaacatgaagtttgtagtgaagtaagtgaaaagaatgttcaggaaattttttttctccatctcttcagttggcatttattgagagttttatttgaatgcttattaaaagtatatgatttataatatttagaaaatagaagaaaaaagaaaactgtagatgttttatcttgttttaatactgtatgtttagtacgtatacatttatgttctagtgtatcaaaatttttcattttcattaaagtgaatccaattttccatattctaggtccattttaaaccatgaaaactttaatcacatattttgtaaagggctgaaagtatgatttaaactacagattgatatattttaattctaaatgaaaggtaatgtaaataagcatggatctgattgaataaagattttaaaatagtaa

SEQ ID NO: 189364 - DNA, 3399 bp, Homo sapiens
  Payload ID: 17395
  Gene Symbol: TMF1
  Gene Name: TATA element modulatory factor 1
  ENST ID: ENST00000488010
  CDS Start-End: 205-2532
cacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttccacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacagctagaaattggcaatctagaaaaaactcgatcaataatggctgaagaactagttaaattaacaaatcaaaatgatgaacttgaagagaaggtgaaggagatacccaaacttagaactcagctaagagatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgg

SEQ ID NO: 189365 - DNA, 3279 bp, Homo sapiens
  Payload ID: 17395
  Gene Symbol: TMF1
  Gene Name: TATA element modulatory factor 1
  ENST ID: ENST00000543976
  CDS Start-End: 1-3279
atgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttccacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggaaggatcaagcatattgaaaacctacagtctcagctaaagctaagggaaggggaaatcactcatttacagctagaaattggcaatctagaaaaaactcgatcaataatggctgaagaactagttaaattaacaaatcaaaatgatgaacttgaagagaaggtgaaggagatacccaaacttagaactcagctaagagatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaa

SEQ ID NO: 189366 - DNA, 1018 bp, Homo sapiens
  Payload ID: 17396
  Gene Symbol: TATDN1
  Gene Name: TatD DNase domain containing 1
  Uniprot ID: Q6P1N9
  ENST ID: ENST00000276692
  CDS Start-End: 39-932
acttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 189367 - DNA, 692 bp, Homo sapiens
  Payload ID: 17396
  Gene Symbol: TATDN1
  Gene Name: TatD DNase domain containing 1
  ENST ID: ENST00000523152
  CDS Start-End: 413-692
aagtggcgaagcctggatttgaacccgggtctaccataggattctgtgaagcgagaggccaccttccaattccgttcccgaagtccttgaacctccaggtacccaggggcctctccacctccatggggccccgagggtcacctccccgagtcctgggtccccatcccttacctctggacgcaccacgactcgaggtggcgtagcgcccgcttataaagccgcaacaccttttgctgatgggtcaggtagggtcccgacgccaagaacgccattacggcgctgaccttccccggccgcgcggagagccgggaaactgcacgcctgctgcgggtgactgagcggggccagccggaagggcggagttgccggcggccacttccgcttccgctggggaggtcctccatgcgcagtcatgagtcgcttcaagtttatcggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcac

SEQ ID NO: 189368 - DNA, 591 bp, Homo sapiens
  Payload ID: 17396
  Gene Symbol: TATDN1
  Gene Name: TatD DNase domain containing 1
  ENST ID: ENST00000523888
  CDS Start-End: 262-591
atgcgcagtcatgagtcgcttcaagtttatcgatcataggtgacagtgatgtgacacgattcagtgagcccaataactgaggcttcaacttaagagttgtggttttctcctggttacaaacagtgccgttttctactcttactttgttttgaaaacgaaaagtcaatatttgaagaactcttaaataataaaatattggtatcaacttgactgaccctatgttcagaggaatttataggggggttcaaaagcatcaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaattt

SEQ ID NO: 189369 - DNA, 889 bp, Homo sapiens
  Payload ID: 17396
  Gene Symbol: TATDN1
  Gene Name: TatD DNase domain containing 1
  Uniprot ID: Q6P1N9
  ENST ID: ENST00000519548
  CDS Start-End: 56-808
ttccgctggggaggtcctccatgcgcagtcatgagtcgcttcaagtttatcgtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatc

SEQ ID NO: 189370 - DNA, 667 bp, Homo sapiens
  Payload ID: 17396
  Gene Symbol: TATDN1
  Gene Name: TatD DNase domain containing 1
  ENST ID: ENST00000522310
  CDS Start-End: 49-171
gccggcggccacttccgcttccgctggggaggtcctccatgcgcagtcatgagtcgcttcaagtttatcgatattggtatcaacttgactgaccctatgttcagaggaatttataggggggttcaaaagcatcaagtttatgattacaggtggaaatctacaagacagtaaagatgcactgcatttggcacaaacaaatggtatcctcatatttcttttaccaaaaaaaaaatgaattaagtaattttgaagaagtctttctgaaaactgcttcaggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttg

SEQ ID NO: 189371 - DNA, 1134 bp, Homo sapiens
  Payload ID: 17396
  Gene Symbol: TATDN1
  Gene Name: TatD DNase domain containing 1
  ENST ID: ENST00000523214
  CDS Start-End: 43-666
ggccacttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgcattatgtatacatatacacgtcatatctgactatggacgaacggtttattctgtgacagtcatacatctctgcagtcaaagaaaccgaggctcaaagaaattaggaaacagctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaa

SEQ ID NO: 189372 - DNA, 629 bp, Homo sapiens
  Payload ID: 17396
  Gene Symbol: TATDN1
  Gene Name: TatD DNase domain containing 1
  ENST ID: ENST00000520321
  CDS Start-End: 27-197
gctggggaggtcctccatgcgcagtcatgagtcgcttcaagtttatcgatgacttacaggatgtaatagggagagctgtcgagattggtgttaaaaagtttatgattacaggtggaaatctacaagacagtaaagatgcactgcatttggcacaaacaaatggtatcctcatatttcttttaccaaaaaaaaaatgaattaagtaattttgaagaagtctttctgaaaactgcttcaggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttg

SEQ ID NO: 189373 - DNA, 677 bp, Homo sapiens
  Payload ID: 17396
  Gene Symbol: TATDN1
  Gene Name: TatD DNase domain containing 1
  ENST ID: ENST00000519776
  CDS Start-End: 64-186
cggaagggcggagttgccggcggccacttccgcttccgctggggaggtcctccatgcgcagtcatgagtcgcttcaagtttatcgatattggtatcaacttgactgaccctatgttcagaggaatttataggggggttcaaaagcatcaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacag

SEQ ID NO: 189374 - DNA, 815 bp, Homo sapiens
  Payload ID: 17396
  Gene Symbol: TATDN1
  Gene Name: TatD DNase domain containing 1
  ENST ID: ENST00000517678
  CDS Start-End: 178-810
gcttccgctggggaggtcctccatgcgcagtcatgagtcgcttcaagtttatcggtaagaggagcgttttccacgcccttgggtctttctgacttgtcccgggcgtcggtcaccaaggtcacaggacccaggaattgcgccctccggcattatattggtatcaacttgactgaccctatgttcagaggaatttataggggggttcaaaagcatcaaggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataatgtgagtatt

SEQ ID NO: 189375 - DNA, 990 bp, Homo sapiens
  Payload ID: 17396
  Gene Symbol: TATDN1
  Gene Name: TatD DNase domain containing 1
  ENST ID: ENST00000522810
  CDS Start-End: 25-990
tggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatgcattatgtatacatatacacgtcatatctgactatggacgaacggtttattctgtgacagtcatacatctctgcagtcaaagaaaccgaggctcaaagaaattaggaaacagctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatat

SEQ ID NO: 189376 - DNA, 604 bp, Homo sapiens
  Payload ID: 17396
  Gene Symbol: TATDN1
  Gene Name: TatD DNase domain containing 1
  ENST ID: ENST00000519232
  CDS Start-End: 1-604
ttcaagtttatcggtaagaggagcgttttccacgcccttgggtctttctgacttgtcccgggcgtcggtcaccaaggtcacaggacccaggaattgcgccctccggcattatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtg

SEQ ID NO: 189377 - DNA, 690 bp, Homo sapiens
  Payload ID: 17396
  Gene Symbol: TATDN1
  Gene Name: TatD DNase domain containing 1
  ENST ID: ENST00000520938
  CDS Start-End: 188-376
ggccacttccgcttccgctggggaggtcctccatgcgcagtcatgagtcgcttcaagtttatcggtaagaggagcgttttccacgcccttgggtctttctgacttgtcccgggcgtcggtcaccaaggtcacaggacccaggaattgcgccctccggcattatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatcctcatatttcttttaccaaaaaaaaaatgaattaagtaattttgaagaagtctttctgaaaactgcttcaggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttgg

SEQ ID NO: 189378 - DNA, 782 bp, Homo sapiens
  Payload ID: 17396
  Gene Symbol: TATDN1
  Gene Name: TatD DNase domain containing 1
  ENST ID: ENST00000522927
  CDS Start-End: 33-260
gcttccgctggggaggtcctccatgcgcagtcatgagtcgcttcaagtttatcgatgacttacaggatgtaatagggagagctgtcgagattggtgttaaaaagtttatgattacaggtggaaatctacaagacagtaaagatgcactgcatttggcacaaacaaatgatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaagttgtctaaagaaatactatata

SEQ ID NO: 189379 - DNA, 726 bp, Homo sapiens
  Payload ID: 17396
  Gene Symbol: TATDN1
  Gene Name: TatD DNase domain containing 1
  ENST ID: ENST00000605953
  CDS Start-End: 37-669
ttccgcttccgctggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttggtacgttcttaggttgctttggtttttaacttttatttaagcagatttcttaaattgtcttacagtgaattgctgatgaagatttattttcattaaa

SEQ ID NO: 189380 - DNA, 915 bp, Homo sapiens
  Payload ID: 17396
  Gene Symbol: TATDN1
  Gene Name: TatD DNase domain containing 1
  ENST ID: ENST00000630259
  CDS Start-End: 91-822
ggccacttccgcttccgctggggaggtcctccatgcgcagtcatgagtcgcttcaagtttatcgatattggtatcaacttgactgaccctatgttcagaggaatttataggggggttcaaaagcatcaaggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaagttgtct

SEQ ID NO: 189381 - DNA, 5342 bp, Homo sapiens
  Payload ID: 17397
  Gene Symbol: TATDN2
  Gene Name: TatD DNase domain containing 2
  Uniprot ID: Q93075
  ENST ID: ENST00000287652
  CDS Start-End: 1052-3337
tttttttttttttttttggtgccttctaattctaattcttcccatttctgggtgtgtacttagtctctctgagccacagttttctgctctataaagtggggtgataatgctcagtacacggtttgctttggctcgatgagaaatccaggtctgaaagcttcaggtacagcggccggcgctgaggaaaacagcgttaagtgaggcgcgtcagcggacaccacctgcctgcacatctggctggcctcaacttcccgctgttcgagcccacgtgagtggctccgccccatctggcttctgaccaatggacgagcttcctaaggcgtaccgtcccgactccaaggcgcctggctttgaggcgggctgcgtcttgctcggagtcccgccccttgccgggtcgagcaatgggcgccttccgtttggcgcaggccccgcccctgtcgctctccggcctgcgggccgcagggctcgttccggagggcgggcgccacggaggccggagtggtcgcagttcgggcggaggccgggccaggcggggctgtagggctggggcaggcggcgggctgcccggcgggacagctgcggcagccggcggggggcgtcctgagttggcggtcgagggcgctgccagctcccgaggggccgctcgggccccttccggcccgggtctggttgggccgcaggagcagggcgggctgcggcgcccgggtctggccctggcctacgggctaagcgcccggccccggggccgcggatccggcagccatgtgtggatcttgaagcgccatgtggtcttctgaagcgcttgacagttctaaagggctttatattgcaaactgatcaaagcgcttcgtagccccggaagcgcttaggcatctccgaagtagcgctgggcaaagtgaaggcttcctgatctcagaagcacgttgtgggcttggaaaccgacggcagcctttagtcaattttggatcgctttgacttctccaacacggtttggcatctctgaaaccttgagaactgtgatgggcagtggaaagaagagggaaaggtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagttggtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagcc

SEQ ID NO: 189382 - DNA, 689 bp, Homo sapiens
  Payload ID: 17397
  Gene Symbol: TATDN2
  Gene Name: TatD DNase domain containing 2
  ENST ID: ENST00000426850
  CDS Start-End: 1-549
ttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaaggtacagtcctcgggagtctcctagaaaaggtcgtaaaactcacattctgtattttttaaaaaccaggacaagtcttttgttgcattttgttaatgtaaagaatataaacatagtatgagcattaagcctga

SEQ ID NO: 189383 - DNA, 4484 bp, Homo sapiens
  Payload ID: 17397
  Gene Symbol: TATDN2
  Gene Name: TatD DNase domain containing 2
  Uniprot ID: Q93075
  ENST ID: ENST00000448281
  CDS Start-End: 163-2448
ggcaaagtgaaggcttcctgatctcagaagcacgttgtgggcttggaaaccgacggcagcctttagtcaattttggatcgctttgacttctccaacacggtttggcatctctgaaaccttgagaactgtgatgggcagtggaaagaagagggaaaggtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtatttgagagacagctgcagctggctgtgtctctaaagaagcccttggtgatccactgccgagaagctgatgaagatctgctagaaatcatgaaaaagtttgtgccccctgactacaagatccataggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaaggtacagtcctcgggagtctcctagaaaagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagttggtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaa

SEQ ID NO: 189384 - DNA, 2321 bp, Homo sapiens
  Payload ID: 17398
  Gene Symbol: TATDN3
  Gene Name: TatD DNase domain containing 3
  Uniprot ID: Q17R31
  ENST ID: ENST00000366973
  CDS Start-End: 39-860
tctgctggccggtctaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatacttttttttttttttgatggagtttcgctgttgttgcccaggctggagtgcaatggcacgatcttggctcactgcaacctccacttcccaggttctagcgagtctcctccctcagcctcccaagtagctgggattacaggcatgtgccaccatgcccagctaattttgtatttttagtagagacagggtttctccatgttggtcaggctggtctcgaactcccgacctcaggtgatccgcccgcctcggcctcccaaagtgctgggattacaggcatgagccactgcgccagcctaaagtgtgttcttaccacctatttttcttcccataggagttagccagtgaagggagaatgtctggttttctatgctgtcagaaatctcttttctaggtttgtaaaattgaacttttagtacttcgaattatttctctttaagataaaaatgcatacgatttttacactgatcttagatttttgacttatgaggccagtggtttaaacaatcattattgaataccaagcccaaaagtttagttaatacaccaattgtaagttctggtctgaattttgtcaacatatttagaatgtaaatggcattattaaaaatgtatctgatttctctgtgaacagtaatatttcatatttttaagtttaaaaatgttagtgtaagccaggcacagtggcattcacctgtagtgccaaccactcaggaggctgagatgggagaccttttaagcctgagtttgagtcaggcctgggcaacatagatgtgagcacctatctctaaaaatgtaaataaataaaaatctcaaaaaaattaaaaatctcaagtgtaaaaacagttctgtagatagatggtagtgatggtagcacatcaatgtgaaggtatttaatgccactgaactgtacacttataacgaattaggataaattttatgttatgtgtatttactacaattttttaaaaatcgtatatgtagtttaacaggtgtggtcaatatcaaaacttaggtatttaatcttgttaaattatataagcagaaaatgctggaaaaagtacctgtcatagaaaaaaataaacttcctaaa

SEQ ID NO: 189385 - DNA, 2389 bp, Homo sapiens
  Payload ID: 17398
  Gene Symbol: TATDN3
  Gene Name: TatD DNase domain containing 3
  Uniprot ID: Q17R31
  ENST ID: ENST00000366974
  CDS Start-End: 95-919
agcatgcatccggctggaaactcaggacgctgcagctgaaacgttccggctccggctctgctggccggtctaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagaagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatacttttttttttttttgatggagtttcgctgttgttgcccaggctggagtgcaatggcacgatcttggctcactgcaacctccacttcccaggttctagcgagtctcctccctcagcctcccaagtagctgggattacaggcatgtgccaccatgcccagctaattttgtatttttagtagagacagggtttctccatgttggtcaggctggtctcgaactcccgacctcaggtgatccgcccgcctcggcctcccaaagtgctgggattacaggcatgagccactgcgccagcctaaagtgtgttcttaccacctatttttcttcccataggagttagccagtgaagggagaatgtctggttttctatgctgtcagaaatctcttttctaggtttgtaaaattgaacttttagtacttcgaattatttctctttaagataaaaatgcatacgatttttacactgatcttagatttttgacttatgaggccagtggtttaaacaatcattattgaataccaagcccaaaagtttagttaatacaccaattgtaagttctggtctgaattttgtcaacatatttagaatgtaaatggcattattaaaaatgtatctgatttctctgtgaacagtaatatttcatatttttaagtttaaaaatgttagtgtaagccaggcacagtggcattcacctgtagtgccaaccactcaggaggctgagatgggagaccttttaagcctgagtttgagtcaggcctgggcaacatagatgtgagcacctatctctaaaaatgtaaataaataaaaatctcaaaaaaattaaaaatctcaagtgtaaaaacagttctgtagatagatggtagtgatggtagcacatcaatgtgaaggtatttaatgccactgaactgtacacttataacgaattaggataaattttatgttatgtgtatttactacaattttttaaaaatcgtatatgtagtttaacaggtgtggtcaatatcaaaacttaggtatttaatcttgttaaattatataagcagaaaatgctggaaaaagtacctgtcatagaaaaaaataaacttcctaaatcaaagtga

SEQ ID NO: 189386 - DNA, 1381 bp, Homo sapiens
  Payload ID: 17398
  Gene Symbol: TATDN3
  Gene Name: TatD DNase domain containing 3
  Uniprot ID: Q17R31
  ENST ID: ENST00000532324
  CDS Start-End: 95-940
agcatgcatccggctggaaactcaggacgctgcagctgaaacgttccggctccggctctgctggccggtctaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagctgctttctcttttctctaagaagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatacttttttttttttttgatggagtttcgctgttgttgcccaggctggagtgcaatggcacgatcttggctc

SEQ ID NO: 189387 - DNA, 498 bp, Homo sapiens
  Payload ID: 17398
  Gene Symbol: TATDN3
  Gene Name: TatD DNase domain containing 3
  ENST ID: ENST00000488246
  CDS Start-End: 1-433
gcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtgtaggttaattattttcctatgttaatagctatagagcaaattaaataatgatcagagttctcctgaaa

SEQ ID NO: 189388 - DNA, 946 bp, Homo sapiens
  Payload ID: 17398
  Gene Symbol: TATDN3
  Gene Name: TatD DNase domain containing 3
  ENST ID: ENST00000527693
  CDS Start-End: 1-125
gaagacctaccatcaaccttttacaagagcaagaagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatacttttttttttttttgatggagtttcgctgttgttgcccaggctggagtgcaatggcacgatcttggctcactgcaacctccacttcccaggttctagcgagtctcctccctcagcctcccaagtagctgggattacaggcatgtgccaccatgcccagctaattttgtatttttagtagagacagggtttctccatgttggtcaggctggtctcgaactcccgacctcaggtgatccgcccgcctcggcctcccaaagtgctgggattacaggcatgagccactgcgccagcctaaagtgtgttcttaccacctat

SEQ ID NO: 189389 - DNA, 492 bp, Homo sapiens
  Payload ID: 17398
  Gene Symbol: TATDN3
  Gene Name: TatD DNase domain containing 3
  ENST ID: ENST00000530441
  CDS Start-End: 72-257
aggacgctgcagctgaaacgttccggctccggctctgctggccggtctaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtgtaggttaattattttcctatgttaatagctatagagcaaattaaataatgatcagagttctcctgaaatggaac

SEQ ID NO: 189390 - DNA, 2206 bp, Homo sapiens
  Payload ID: 17398
  Gene Symbol: TATDN3
  Gene Name: TatD DNase domain containing 3
  ENST ID: ENST00000525574
  CDS Start-End: 1-182
gagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagaagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatacttttttttttttttgatggagtttcgctgttgttgcccaggctggagtgcaatggcacgatcttggctcactgcaacctccacttcccaggttctagcgagtctcctccctcagcctcccaagtagctgggattacaggcatgtgccaccatgcccagctaattttgtatttttagtagagacagggtttctccatgttggtcaggctggtctcgaactcccgacctcaggtgatccgcccgcctcggcctcccaaagtgctgggattacaggcatgagccactgcgccagcctaaagtgtgttcttaccacctatttttcttcccataggagttagccagtgaagggagaatgtctggttttctatgctgtcagaaatctcttttctaggtttgtaaaattgaacttttagtacttcgaattatttctctttaagataaaaatgcatacgatttttacactgatcttagatttttgacttatgaggccagtggtttaaacaatcattattgaataccaagcccaaaagtttagttaatacaccaattgtaagttctggtctgaattttgtcaacatatttagaatgtaaatggcattattaaaaatgtatctgatttctctgtgaacagtaatatttcatatttttaagtttaaaaatgttagtgtaagccaggcacagtggcattcacctgtagtgccaaccactcaggaggctgagatgggagaccttttaagcctgagtttgagtcaggcctgggcaacatagatgtgagcacctatctctaaaaatgtaaataaataaaaatctcaaaaaaattaaaaatctcaagtgtaaaaacagttctgtagatagatggtagtgatggtagcacatcaatgtgaaggtatttaatgccactgaactgtacacttataacgaattaggataaattttatgttatgtgtatttactacaattttttaaaaatcgtatatgtagtttaacaggtgtggtcaatatcaaaacttaggtatttaatcttgttaaattatataagcagaaaatgctggaaaaagtacctgtcatagaaaaaaataaacttcctaaatcaaagtga

SEQ ID NO: 189391 - DNA, 1291 bp, Homo sapiens
  Payload ID: 17398
  Gene Symbol: TATDN3
  Gene Name: TatD DNase domain containing 3
  Uniprot ID: Q17R31
  ENST ID: ENST00000531963
  CDS Start-End: 39-761
tctgctggccggtctaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagctgctttctcttttctctaagaagcagaaacttgtgaaacaattgcctttaacttctatatgcttagaaacagattcacctgcactaggaccagaaaaacagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattgcccttttatatagaaccaccacctgaactgaaaccattgctactgggaagggtggctcccacaggaagagtataagcactactgtgatgaggatggagtaagctaaagtatacttttttttttttttgatggagtttcgctgttgttgcccaggctggagtgcaatggcacgatcttggctc

SEQ ID NO: 189392 - DNA, 547 bp, Homo sapiens
  Payload ID: 17398
  Gene Symbol: TATDN3
  Gene Name: TatD DNase domain containing 3
  ENST ID: ENST00000530399
  CDS Start-End: 64-547
agatgttcttgaagtctgaaagaggaaggggagctagtcaaggagactgacaagtagccaccaatgagagagtggtattgcagaagtgaagggtggaaagcatttcaagaaggaaggagtaagcaagatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaag

SEQ ID NO: 189393 - DNA, 417 bp, Homo sapiens
  Payload ID: 17398
  Gene Symbol: TATDN3
  Gene Name: TatD DNase domain containing 3
  ENST ID: ENST00000533650
  CDS Start-End: 12-317
gccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggtgctgagaaggtactgctgcatgcatttgatggtcggccatctgtagccatggaaggagtaagagctgggtacttcttctcaattcccccttctatcataagaagtggacagaagcagaaacttgtgaaacaattgcctttaacttc

SEQ ID NO: 189394 - DNA, 1073 bp, Homo sapiens
  Payload ID: 17398
  Gene Symbol: TATDN3
  Gene Name: TatD DNase domain containing 3
  Uniprot ID: Q17R31
  ENST ID: ENST00000526641
  CDS Start-End: 53-814
gttccggctccggctctgctggccggtctaaagcggcagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaaggtgctgagaaggtactgctgcatgcatttgatggtcggccatctgtagccatggaaggagtaagagctgggtacttcttctcaattcccccttctatcataagaagtggacagaagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctgatgaagaatctgaactgaagaagctgttttatagggttatagaagattgtaattgtagagaaatatttctcttagaaataaaactgggcttggatcctgaaaccctgggttctgattctagccttgtgctgcttttcaattagccgagttctggcaggatattgggaaaatactgctacttcttacattg

SEQ ID NO: 189395 - DNA, 794 bp, Homo sapiens
  Payload ID: 17398
  Gene Symbol: TATDN3
  Gene Name: TatD DNase domain containing 3
  ENST ID: ENST00000526997
  CDS Start-End: 17-592
cagccgccggggcgcaatgcgagcggctggcgtaggcttggtggactgtcactgccacctctccgccccggactttgaccgcgatttggatgatgtgttggagaaagccaagaaggccaatgttgtggcccttgtggcagttgccgaacattcaggagaatttgaaaagattatgcaactttcagaaaggtataatgggtttgtcctgccatgcttgggtgttcatccagttcaaggacttccaccagaagaccaaagaagtgtcacactaaaggatttggatgtagctttgcccattattgagaattataaggatcggttgttggcaattggagaggttggactagatttctcccccagatttgctggcactggtgaacagaaggaagagcaaagacaagtcctaatcagacagatccagttagccaaaagactaaatttgcctgtaaatgtgcactcacgctctgctggaagacctaccatcaaccttttacaagagcaagcagaaacttgtgaaacaattgcctttaacttctatatgcttagaaacagattcacctgcactaggaccagaaaaacaggtacggaatgagccctggaacatttctatttcagcagaatatattgcccaggtgaaagggatctcagtggaagaagttatagaagtgacgacacagaatgcattaaaactgtttcctaagctccgacacttgctccagaaatagcttcaaaaccatccattacaaaatcgaatcaactgcagggggcagcatttgaaaaatagaaatgttctg

SEQ ID NO: 189396 - DNA, 551 bp, Homo sapiens
  Payload ID: 17398
  Gene Symbol: TATDN3
  Gene Name: TatD DNase domain containing 3
  ENST ID: ENST00000606486
  CDS Start-End: 1-95
catgcttgggtgttcatccagttcaaggacttccaccagaagaccaaagaagtgtcacactaaaggtaacagtcatacaaaacaggaaccattaaaaacaaacaaacgaaagaattatttgactcagtaatcctcctctttctaatttatattctcaggaaataatccaaaagaaggaaacattaccttctttaacaaagatgtttgttgcaacattattcgtaatagagaaaaagtagaaacagcctagaggttcagaaacaaaggaatcattagttaagttgtagagtgttaaatataatgcatttatagaaaatgaggattataaagtattatagcacatggaaaatacttactgtataatatagggagaaaagcaggataccaaatagcatattcactatgagtgacatctacataagcatatattcataaggaaaagactgcagagaaaacacagaaatgatagtaattgtgatgatctgttagaattatctgtaacttttttcacatttttttggtactgtagtcatgttgctttggcaaaaaag

SEQ ID NO: 189397 - DNA, 6932 bp, Homo sapiens
  Payload ID: 17399
  Gene Symbol: TTBK1
  Gene Name: tau tubulin kinase 1
  Uniprot ID: Q5TCY1
  ENST ID: ENST00000259750
  CDS Start-End: 84-4049
cagccgcagccgcagcgggcacagagcaggtagatggccccctcagggcaggcccggcggacacccctccctctggctggcggatgcagtgcctagcggccgcccttaaggacgaaaccaacatgagtgggggaggggagcaggccgacatcctgccggccaactacgtggtcaaggatcgctggaaggtgctgaaaaagatcgggggcgggggctttggtgagatctacgaggccatggacctgctgaccagggagaatgtggccctcaaggtggagtcagcccagcagcccaagcaggtcctcaagatggaggtggccgtgctcaagaagttgcaagggaaggaccatgtgtgcaggttcattggctgtggcaggaacgagaagtttaactatgtagtgatgcagctccagggccggaacctggccgacctgcgccgtagccagccgcgaggcaccttcacgctgagcaccacattgcggctgggcaagcagatcttggagtccatcgaggccatccactctgtgggcttcctgcaccgtgacatcaagccttcaaactttgccatgggcaggctgccctccacctacaggaagtgctatatgctggacttcgggctggcccggcagtacaccaacaccacgggggatgtgcggccccctcggaatgtggccgggtttcgaggaacggttcgctatgcctcagtcaatgcccacaagaaccgggagatgggccgccacgacgacctgtggtccctcttctacatgctggtggagtttgcagtgggccagctgccctggaggaagatcaaggacaaggaacaggtagggatgatcaaggagaagtatgagcaccggatgctgctgaagcacatgccgtcagagttccacctcttcctggaccacattgccagcctcgactacttcaccaagcccgactaccagttgatcatgtcagtgtttgagaacagcatgaaggagaggggcattgccgagaatgaggcctttgactgggagaaggcaggcaccgatgccctcctgtccacgagcacctctaccccgccccagcagaacacccggcagacggcagccatgtttggggtggtcaatgtgacgccagtgcctggggacctgctccgggagaacaccgaggatgtgctacagggagagcacctgagtgaccaggagaatgcacccccaattctgcccgggaggccctctgaggggctgggccccagtccccaccttgtcccccaccccgggggtcctgaggctgaagtctgggaggagacagatgtcaaccggaacaaactccggatcaacatcggcaaaagcccctgtgtggaggaggaacagagccgaggcatgggggtccccagctccccagtgcgtgcccccccagactcccccacaaccccagtccgttctctgcgctaccggagggtgaacagccctgagtcagaaaggctgtccacggcggacgggcgagtggagctacctgagaggaggtcacggatggatctgcctggctcgccctcgcgccaggcctgctcctctcagccagcccagatgctgtcagtggacacaggccacgctgaccgacaggccagtggccgcatggacgtgtcagcctctgtggagcaggaggccctgagcaacgccttccgctcggtgccgctggctgaggaggaggatttcgacagcaaagagtgggtcatcatcgacaaggagacggagctcaaggacttccctccaggggctgagcccagcacatcgggcaccacggatgaggagcccgaggagctgcggccactgcccgaggagggcgaagagcggcggcggctgggggcagagcccaccgtccggccccggggacgcagcatgcaggcgctggcggaggaggacctgcagcatttgccgccccagcccctgccaccccagctgagccagggcgatggccgttccgagacgtcacagccccccacgcctggcagcccttcccactcacccctgcactcgggaccccgccctcgacggagagagtcggaccccacaggcccacagagacaggtgttctccgtggcgcccccatttgaggtgaatggcctcccacgagctgtgcctctgagtctgccctaccaggacttcaaaagagacctctccgattaccgagaacgggcgcggttgctcaacagggtccggagggtgggcttctcgcacatgctgctcaccaccccccaggtcccactggctcctgttcagcctcaggctaatgggaaggaggaagaggaggaggaggaggaagatgaggaagaggaagaagaggatgaggaagaagaagaggaggaagaggaagaggaggaggaagaagaggaggaggaggaagaggaggaggaggctgcagcggcagttgccttgggggaggtgctggggcctcgtagtggctccagcagtgaggggagtgagaggagcactgaccggagccaggagggtgccccgtccacgctgctggcagacgatcagaaggagtccaggggccgggcctccatggccgatggggacctggagcctgaggagggctccaaaacgctggtgcttgtctctcctggcgacatgaagaagtcgcccgtcactgccgaactggcccccgaccccgacctgggcaccctggctgccctcactcctcagcatgagcggccccagcccacgggcagccagctggacgtatctgagccaggcaccctgtcctctgtcctcaagtctgagcccaagcccccggggcctggggcagggctgggggccgggacagtgaccacaggggtcgggggcgtggcagtcacctcctcacccttcaccaaagttgagaggacctttgtgcacattgcggagaaaacccacctcaacgtcatgtcttccggtggacaagccttgcggtctgaggagttcagcgctgggggcgagctgggtctggagctggcctctgatgggggcgctgtggaggagggggcccgagcgcccctggagaacggcctcgccctgtcagggctgaatggggctgagatagagggctctgccctgtctggggccccccgggaaaccccctcagagatggccacaaactcactgcccaatggcccggcccttgcagacgggccagccccggtgtccccgctggagccaagccctgagaaagtggccaccatctcccccagacgccatgctatgccaggctctcgccccaggagccgtatccctgtcctgctctctgaggaggacacgggctcggagccctcaggctcactgtcggccaaagagcggtggagcaagcgggctcggccgcagcaggacctggcgcggctggtgatggagaagaggcagggccgcctgctgttgcggctggcctcaggggcctcgtcctcctccagtgaggagcagcgccgtgcctctgagaccctctcaggcacgggctctgaggaggacacgcccgcctctgagccggcagcggccttgcccaggaagagcgggagggcagccgccaccaggagccggattccccgccccattggcctccgcatgcccatgcctgttgcagcccagcagcccgccagcagatcccatggcgcggccccagcattggacacagccatcaccagcaggctccagctgcagacgcccccagggtcggccactgctgctgacctccgccccaaacaacctcctggccgcggcctgggcccagggcgagcccaagccggagccaggcccccagcgccgcgcagcccgcgcctccccgcgtccacatccgccgcgcgcaatgccagcgcgtccccccggagccagtccctgtcccgcagagagagcccctccccctcgcaccaggcccggcccggggtccccccgccccggggcgtcccgccggcccgggcccagcctgatggcaccccctcccccgggggctccaagaaaggacccagagggaaactccaggctcagcgcgcaacaaccaaaggccgggcaggaggcgcggagggccgggctggggccagataatgacgcccgctgctctccgcggtcccccaccctcaccccggccccccacccgcagccggccacactggagcagctcccagcacagccttacgcgcccgacgcgcgccacccgcggccccagctttccgcctgcacccgcgaggacgcgcgcgagcacacgcggcgccccgccaggccttagggcccgtgggggacgcggccccgcgccgcggggagggtctgcctccccttcctcgccctgtgtcctctcatcctcccgccgcccgtcaggccggccagcctcacatcagtctctccgccccggggaaggctcagccacttttcatcgaggactccacttctggggacgcctggttcgttcgcccaccaggcctaggctacgctccatgctcccccagcaatctctgcctacacctcctgcggcgccttgccctcctccgacccctttccagccaaagtccccccaccccttcagagaagcagcctcaaattccagaagtggaggctccagcctccccgcgagggtccagccccacagtcttctgggagccattgtggccagggacggcctctggactgccaggctgggttggggacccagggaacatcggtctactcaggtgtgagggggcaggtctgacctgccccaaagttggctccatcctggacaactcggtgagaggcagtgggcaagtgatcttggagatgggtgggcaggtgattctgtgggcaggggatgtgctcccctgcacctctggggtgcagaaacctcttgcctccagatttgggtggagcctctgtgggaaccataggaagtgtgtgggctgccttcctgggcaagtatttcccagtgggaagttggagggggctttaacaaagttttactccctcccctgttcccctgatctagtgctcaggacccttcaccatcaggaattccttcctgtcatctaacctcagtcctgcctactgcagttccagccaacctgctctttcctgagttcaaagcaggtggagactggctggttaccatctttgcactggcccttcggagattcggggactcagttctggtggggtcaccctccctgtcctcccgcctgtgggagggagggagggctggctcaggcatcgtctcccgcaatgggcagagagagcagagacaggtggaccaacagacagctggcccctggaggcagaaaggcccttctaacttccagattgtatgcttgagtgatgggtccccagcccaagcccactcttccctcagctcacccttcagcctgttccttcttgccctgaccccagcccgtgcagctgctctactccaggaatggatgtggggactcttcctgggttctggctcctgcatagctcaccccacctcatcatgagcctcaactgcctacatctggggcaagcagcacaccggctgcagatgggacagccagccctgcctatctggacaggcccctgcagcctctgtcccctggcctagcctctctgtccttccctgagtcacagagagcaagccaagacatccagggaaagaggaagaaaggccttagtgtgccccagcagtctggctgcgtccagccaccatcacccggaaggatgcccacaaggcagctgaccctgaaagcagcctccccctcatggagagtcagcagcttgggcagccacttccaggccagggtggtggcttctctgcagaccagctgaggggaggactcctgggtggacagcctttgacgtccaccccacgctgatgcagaagctcccagaacactcaggaaacttctccggacagagccctccttgtcaacttgaggccctcccaaggccctctactgccctctgggtccagcagagggagtggaggaagggccactgcctcccacctagagcttctccgaatgacaatcagctcgtgccaggtggggaccaggatatgactcctggtgcccaggccctgggcctgctccttgccaccaaccgaaccgtgaatgtagggcccccagcctcacctctgccccaggaccaacaacaccctggtttggagctgggaggaagaagggggcctgagagagccccaggtccattctacccccagcttcactcagcactggagctggcagagacgcaaaacccagtctgcccttgggattccaaacctccctagggctcccaactgacctcaggcctctgagtcactgaatgtcaccaggagaggtgggggagggaaagtgggccagtggggagggggtcacctaggggactgcctctgtgcctctccccaggaagcatccagggcagaggaagccacatctcccggtgcccccaaccccagctgcagcctcctccccctgagcattcattctctccaccaggcctccaggtcctgagcccttcctctgtaaaagtgtcacaccacctccctcagcacttccccatcacaacaacctatgtcactgactcagatgcagggtctgctcaccccaacacatgccttccctccccagccacaccgtgcacgaagggggcacaggagaggagaggggctgtgccccaggctccccatttcccagctcctcacagaggcctggtttgctcagtcttctgaactccagggaccagccctggtgggcatggggtggggagcagggagttgcccttcccctccctcgggaagccacctaagaatgtttacatgccaaacagaatgtaacacccctccccaagcccttcccagtcactgcatggcctctgcccatcctgcacctgtccaccccaccccaacaccctggaagccactgtcaatgattagatcgggtctcggaagggaagtagccatcacaccattaaaaagcctgtggacctttt

SEQ ID NO: 189398 - DNA, 2449 bp, Homo sapiens
  Payload ID: 17399
  Gene Symbol: TTBK1
  Gene Name: tau tubulin kinase 1
  ENST ID: ENST00000304139
  CDS Start-End: 163-2168
aataaaaggaacgagggtctggcgaagacaggagtgttcctctgaaacctcggggcccctggcaccggagcttagtttctggcggattggaggcagaatgacatttgcactgaagtgctgaaaaagatcgggggcgggggctttggtgagatctacgaggccatggacctgctgaccagggagaatgtggccctcaaggtggagtcagcccagcagcccaagcaggtcctcaagatggaggtggccgtgctcaagaagttgcaagggaaggaccatgtgtgcaggttcattggctgtggcaggaacgagaagtttaactatgtagtgatgcagctccagggccggaacctggccgacctgcgccgtagccagccgcgaggcaccttcacgctgagcaccacattgcggctgggcaagcagatcttggagtccatcgaggccatccactctgtgggcttcctgcaccgtgacatcaagccttcaaactttgccatgggcaggctgccctccacctacaggaagtgctatatgctggacttcgggctggcccggcagtacaccaacaccacgggggatgtgcggccccctcggaatgtggccgggtttcgaggaacggttcgctatgcctcagtcaatgcccacaagaaccgggagatgggccgccacgacgacctgtggtccctcttctacatgctggtggagtttgcagtgggccagctgccctggaggaagatcaaggacaaggaacaggtagggatgatcaaggagaagtatgagcaccggatgctgctgaagcacatgccgtcagagttccacctcttcctggaccacattgccagcctcgactacttcaccaagcccgactaccagttgatcatgtcagtgtttgagaacagcatgaaggagaggggcattgccgagaatgaggcctttgactgggagaaggcaggcaccgatgccctcctgtccacgagcacctctaccccgccccagcagaacacccggcagacggcagccatgtttggggtggtcaatgtgacgccagtgcctggggacctgctccgggagaacaccgaggatgtgctacagggagagcacctgagtgaccaggagaatgcacccccaattctgcccgggaggccctctgaggggctgggccccagtccccaccttgtcccccaccccgggggtcctgaggctgaagtctgggaggagacagatgtcaaccggaacaaactccggatcaacatcggcaaaagcccctgtgtggaggaggaacagagccgaggcatgggggtccccagctccccagtgcgtgcccccccagactcccccacaaccccagtccgttctctgcgctaccggagggtgaacagccctgagtcagaaaggctgtccacggcggacgggcgagtggagctacctgagaggaggtcacggatggatctgcctggctcgccctcgcgccaggcctgctcctctcagccagcccagatgctgtcagtggacacaggccacgctgaccgacaggccagtggccgcatggacgtgtcagcctctgtggagcaggaggccctgagcaacgccttccgctcggtgccgctggctgaggaggaggatttcgacagcaaagagtgggtcatcatcgacaaggagacggagctcaaggacttccctccaggggctgagcccagcacatcgggcaccacggatgaggagcccgaggagctgcggccactgcccgaggagggcgaagagcggcggcggctgggggcagagcccaccgtccggccccggggacgcagcatgcaggcgctggcggaggaggacctgcagcatttgccgccccagcccctgccaccccagctgagccagggcgatggccgttccgagacgtcacagccccccacgcctggcagcccttcccactcacccctgcactcgggaccccgccctcgacggagagagtcggaccccacaggcccacagagacagttggaggaggacagactctcggggcactccctcccgcggtacagccccctgcgacgactggcgtcctccgtgttctcctcctccacgctggagacggagcattaccctcaccccggcggcggcggctcctcgggctcctccggttccctcattcagcgcagccgctcggctgagagcagccctgtgcgggcgccccaccggcgccacgcgcccctcgctgctggcaaccacagactcatgccctcggtgctccgcatctcgcggtcccagctgcagcaggtgtgggcccggttcacccacaagacctaggctgggccccccccctcctggagggggcaggtgggggggggtggggagcaggcagaggaccatggttccttcccaggacgcaataatcacacactcacacatcccatcccaccccatcatgcaatacagcccccctagaacgttg

SEQ ID NO: 189399 - DNA, 10905 bp, Homo sapiens
  Payload ID: 17400
  Gene Symbol: TTBK2
  Gene Name: tau tubulin kinase 2
  Uniprot ID: Q6IQ55
  ENST ID: ENST00000267890
  CDS Start-End: 110-3844
cagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgttgagaaagattgggggtgggggctttggagaaatttacgatgccttggacatgctcaccagggaaaatgttgcactgaaggtggaatcagctcaacaaccaaaacaagttctgaaaatggaagttgctgttttgaaaaagctgcaagggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcattctgtgggattcttgcatcgagacatcaaaccgtcgaacttcgctatgggtcgctttcctagtacatgtaggaaatgttacatgcttgattttggcttggctcgacaatttaccaattcctgtggtgacgtcagaccacctcgagctgtggcaggttttcgagggacagttcgttatgcatcaatcaacgcacatcggaacagggaaatgggaagacatgatgacctttggtccttattctacatgttggtggagtttgtggttggtcagctgccctggagaaaaataaaggacaaggagcaagtaggctctattaaggagagatatgaccacaggctcatgttgaaacatctccctccagaattcagcatctttctagaccatatctcttctttggattattttacaaaaccagactaccagcttcttacatccgtgtttgacaatagcatcaagacttttggagtaattgagagtgacccttttgactgggagaagactggaaatgatggctccctaacaaccaccactacttctaccacccctcagttgcacactcgcttgacccctgctgcaattggaattgccaatgctactcccatccctggagacttgcttcgagaaaatacagatgaggtatttccagatgaacagcttagcgatggagaaaatggcatccctgttggtgtgtcaccagataaattgcctggatctctgggacacccccgtccccaggagaaggatgtttgggaagagatggatgccaacaaaaacaagataaagcttggaatttgtaaggctgctactgaagaggagaacagccatggccaggcaaatggtcttctcaatgctccaagccttgggtcaccaattcgtgtccgctcagagattactcagccagacagagatattccactggtgcgaaagttacgttccattcacagctttgagctggaaaaacgtctgaccctggagccaaagccagacactgacaagttccttgagacctgcctggagaaaatgcagaaagataccagtgcaggaaaagaatctattctccctgctctgctgcataagccttgcgttcctgctgtgtcccgtactgaccacatctggcactatgatgaagaatatcttccagatgcctccaagcctgcttctgccaacacccctgagcaggcagatggtggtggcagcaatggatttatagctgttaacctgagctcttgcaagcaagaaattgattccaaagaatgggtgattgtggacaaggagcaggaccttcaggattttaggacaaatgaggctgtaggacataaaacaactggaagtccttctgatgaggagcctgaagtacttcaagtcctggaggcatcacctcaagatgaaaagctccagttaggtccttgggcagaaaatgatcatttaaagaaggaaacctcaggtgtggtcttagcactttctgcagagggtcctcctactgctgcttcagaacaatatacagataggctggaactccagcctggagctgctagtcagtttattgcagcgacgcccacaagtctaatggaggcgcaggcagaaggaccccttacagcgattacaattcctagaccttctgtggcatctacacagtcaacttcaggaagctttcactgtggtcagcagccagagaagaaagatcttcagcccatggagcccactgtggaactttactctccaagggaaaacttctctggcttggttgtgacagagggtgaacctcctagtggaggaagcagaacagatttggggcttcagatagatcacattggtcatgacatgttacccaacattagagaaagtaacaaatctcaagacctgggaccaaaagaacttcctgatcataatagactggttgtgagagaatttgaaaatctccctggggaaactgaagagaaaagcatccttttagagtcagataatgaagatgagaagttaagtagagggcagcattgtattgagatctcctctctcccaggagatttggtaattgtggaaaaggatcactcagctactactgaacctcttgatgtgacaaaaacacagacttttagtgtggtgccaaatcaagacaaaaataatgagataatgaagcttctgacagttggaacttcagaaatttcttccagagacattgacccacatgttgaaggtcagataggccaagtggcagaaatgcaaaaaaataagatatctaaggatgatgacatcatgagtgaagacttgccaggtcatcaaggagacctctctacttttttgcaccaagagggcaagagagagaaaatcacccctagaaatggagaactatttcattgtgtttcagagaatgaacatggtgccccaacccggaaggatatggttaggtcatcctttgtaactagacacagccgaatccctgttttagcacaagagatagactcaactttggaatcatcctctccagtttctgcaaaagaaaagctcctccaaaagaaagcctatcagccagacctagtcaagcttctggtggaaaaaagacaattcaagtccttccttggcgacctctcaagtgcctctgataaattgctagaggagaaactagctactgttcctgctcccttttgtgaggaggaagtgctcactcccttttcaagactgacagtagattctcacctgagtaggtcagctgaagatagctttctgtcacccatcatctcccagtctagaaagagcaaaattccaaggccagtttcatgggtcaacacagatcaggtcaatagctcaacttcgtctcagttctttcctcggccaccaccaggaaagccacccacgaggcctggagtagaagccaggctacgcagatataaagtcctagggagtagtaactccgactcagaccttttctcccgcctggcccaaattcttcaaaatggatctcagaaaccccggagcactactcagtgcaagagtccaggatctcctcacaatccaaaaacaccacccaagagtccagttgtccctcgcaggagtcccagtgcctctcctcgaagctcatccttgcctcgcacgtctagttcctcaccatctagggctggacggccccaccatgaccagaggagttcgtccccacatctggggagaagcaagtcacctcccagccactcaggatcttcctcctccaggaggtcctgccaacaggagcattgcaaacccagcaagaatggcctgaaaggatccggcagcctccaccaccactcagccagcactaaaaccccccaagggaagagtaagccagccagtaaactcagcagataggagccaggctgcatctctttgaaaggtgtgagatcttcctcctaaacctgatgcatgtgtgtccctgtactttctatgtaaaaaaatcagtgttgatcttctcttgcaaaagaaagtaacatgatcaattatttataagaagacataatacatgataaggaattacctaaggcaggcagcaagtagattaggaatcaatgtctttgtacaagaaggaaaaatagagcaaaaatccaagggggagaaactcattaaaatgagctctcattttttaagctgcctttgaaacaaaagagttgaggataggagatagaatggaattttaggggggttgcctaatttttttaagcctcaattcaaagattatatagcaaaagtgaaacttcttgtttgatattttcattcaaaactttcccaccctgaagagtcattgatcagatattagattatataagaagtctgttgccagggagccagtattcatgtatatttggcttgtgtgtttatttcgtgtattgagaatgaacacctttactttgcctcattcctagtaccctccctggagttcagatttttttttaaaattttgtatgtctcgtctgattcaatctctctgcttttattttatggtcctagttgtactatcaaatccaattacttttttttaggtccccctgattttttttttttagagcaagagttcttaacatattacatttttattatgaaaaataagaaagttaggtaaaggaaagaaaagtctaactagagctattttgcaggctttagtgtttagggagagaaagaaagtgtgggttaatagccttcaagatagaagatgccctttcatctctgttaagtgtcctcctttagaaacttgagtagaaggaaaactgaccagagtagactgcttccttaagtcttctgggttccaactgtttgtaatatcagcatccaagatgatacgagggaagcacaatgctttggactgtgatttgagatttagaaataaattagatatattattgaggcttagaatcctcaaactttgtattttatacatttagccaataaggaattaatatctggggaaataaatttaggcaaatatttcttttttaatgttttattacctgcttctcctgtgttttagttcaacatttgggcttcttggcctgattttcatacaatctcaatttacgaagctgtaaagaggaagatatttgttctaatctcactcttctaataggaatcaggcaaatgaaagtctaccagacttttaaaatgggctgtttttatactctctaggtgttttgtgttgtaaagaccttattaaggtcaggtaaattggtctgcttgctgttgaaatttgccttctagcaaacatatgtgctttctgtttgaccttgtgtttgctgccaaacctaatacagttgaattgggaaacaaaaaaaaaagaaaggaatacatttcctccccaagtgaacatcttctaatgctgcatcaaagctgccctgaagctgcactgaacttctcttgttctctttatctgtgttgagctttttaaaaaaacaaactcaaaacactattgaggcatataacgtctcttataagaaatgtagcatagtgtggaatcttaatttctctccagtttcaaacactccagaggaatgcaatagataagacatacttgctgtttatctaaagcaactgtaatattggaagatcagtccttctgtattatattgtataatagttgctataacactacttgcatgtcttcatggtaaattatataaatatttataaatatatagagagacatatccttatatagagtcattctttgtcattctccatttgtaatttcgagatcacagatggcgaaattccttttctattgtgtgcctcatgtacacttgggccttgcctatcttcattttctgaaactatgttcttggcatgtgacacctcagagtcttcttgccttccctgtgtacaatgcaagggtgggcagtatttaacaagccaagataggttatttaattttcatttcaaaaagattttaatagggaaaaaattacagggacatgcttgtaatactggttcagagatttgtcatgttaatcacatagttctctccttatagttagagtggataaactgggatgatgatgagtctgacagatttttaaaacatttcttaaaaattgccattctactttcctcttttcatctcactttttttgcagggggtcgggggaataatgaagaaattgtcatatttctgttgcattagctaaattgtgctaaaagtagctagctttaaatcctgacccctttagtcggaaatatgctagtagtaatcattggaaaagctgatgaagctacaactgtggtacgtgtgtgtgattttatttcttattggcatttctctgctggcagttggaactgacagtgatgggaatgtggcaactgaatgttttctctctttcttggttccttccatttttatctcaacttttctagtgtgttgtccccttttctaaatggcattgacaaactcatcaagatccagagataaacagtccatcgtttaagaatattttattttgcatgtagaggaaagaattaaccaaagacgtttctgctctgatactttctaaagaaaacagactaattatatataagtggtatcaataggtctgcttataagtattgtcctatgtagagatttactttttggtttttacaagcatagtttgcgcttttagatgtctctcaggtgaaaaatagaagttggcagccctgagcaagcacctgtgacacagggatttttattttagttttaaagtatgatacagagaatgaggtttttggtttgatttggtttggttgtgttttttagttctttattttttatttgggggttctcttagtgatggcatatttcaggtttcagtgacatagatcaagtaattttaaaccaatttggttattctatctaagatgagggacatggctattaaggtcaagccaaactatactaaaagtagtatagggcagcagttaaaattatcttttgaaaatcaagtattacctggtttcttctgtcacaacagaatagctggttacctagtcagtcacagttgcccttgccttcccttgttagtccctggaggtacttgagtggaacagaaggtagaattagcaacagctcaatcactttaggtagcatttctcctgaattctgctgccaaatcctcagggtctatggattggttgaaatagtaaaatcacacatagtgatttcttgcacagcgtagaggcgtttaattttagtgtatagtgaacaaagaaggaaaactgggtcatataaaatttaaccttaaaacacagattataaatatctttgaatgttaagccctaggcagacagacactctcattcttaactctggtatgcaagctggccttgctgacagtggcatagttacattaactgttttttaagttgcatgttgtgatgtgaatgttttttgtaaaagttgccaagttaatcgagtcctaaataagtagccaaatggtaactgagacccactgtagacattactcgctttatattatttgctttcaaatactaaaacctcagctgctaattcagcgctctaggtgtacagtgtctccttcccttggctcctagcaatgtagggaacttgaggttcttcagtatcttcagagattccttccaggccacatatttttatgctaatacttctatagttgcattcaatctacaaggagaaagtgtacattggtgcatgttttataaacccagacacagatagctaaaaccataattagtttttctatacccagagctttgaattaaaaacagatgctttttttttccccaagagcagacagttctacattcctaacattaggaattggtgatacgagaagcaggatccagaattcagaatgatttagtgagactcggtgaaaaaaatgcattttcccctggctgtttgaaaatttacttatttgcagataagtctagatttagtcttggagatcaaagtcttttatattttaaaaacttattctttatattgatcaaacatggcatatgttagagaaccacttcttctgtcatgtttatgtattttggaattaagttgtttgcattcactttcaaaatctgcccatttctgtttatgtgcacttaccacagatgtgtcgggactttgcctcaggggagaggtactttagcacctgtgtcactgaggagatggagtggttgacaagtactgttgcgctgtgtaacttggggtttggccctgtggacaatatattagcagaatgataccacacaaaagtattacaggattaaggcatgtaacttctatggtagtccttatgtatcagcgtatacccaagttcagaaaccacaggtgcatttttagacctttacttagagaactaaaggcagttccaaccatcagcccatatggcgggattaatgcatgaaaaccctcagagggtgttgggacatcctacttccctgtcctcacccagtggaactctggtgtgtgccttgaggataaggaagtagagtggaaactcatcctatcattgagtattctcaatattttggccttccctctggaattatgagaaatttaacaaagtctcaggaacctttagaatccattgtccaacactgctagaaaaactgtaggaggtacatggagaattcctatagttcttaggtaagtgcaagacatggcacagggatccctatccacataaaggggaatctggatgctgcacacctcaattctgagaaatccctgactgaacttggaattatgacagtaaagttttcgtcctttagttttctagagcagctcacagaaattttaaaaagtaaaacaaggccaggcgcagtggctcatgcctgtaatcccagctctttgggaggctgaggcgggcagatcacgaggtgaggagatcgagaccatcctggctaacagggtgaaaccccgtctctactgaaaatacaaaaaattagctgggcatggtggcgggcgcctgtagtcccagatgctcaggaggctgaggcaggagaatcgcttgaacctgggaggcagaagattacagtaagccaagatcgccccactgcactccagcctgggcgacagagtgagactccgtctcaaaaaaaaaaaaaaaaaaaagtaaaacaaaaataaagtctatgcccattaagacgtcttctaattcagttgtgattgtctgctcctacttaaaaaaatatttaagcttgatgtttaattattccctttcagcaaatttggatcagaaaattaaagtatgtgacaagatcaggtcaccttgaatttccacacaatctcaagacactgaatagcaaaaaagtaacattacacagtaatgattaggatatttccttagactttgctggatctttggtcttaaggtaacatgtaaaagtagtgaagcctttcctttcatggccctgtgcaatgtaacggttttctgcctcctcttcagctggaagcgttagtggtagtatgggcacagaatatatgtacactggcgatgctgaccatgcctcccaggtaccctggctctgggttccttgacctagggaacaagattggatgaggcagatctttgagcccatgtgactatagaatttgctgatgatataattttacaataacaatggataggaattttacctctctttttattagtttaatattatttaatattatgtacataagtgttcactcgcctaattaaaaacattgagtaaaccaagtttttatatagactacccttgccatatgatgctctttttctctaataatatgcagtttaaatcctgaggaatcaatgcccagcatttcaccacatctgaactctgtgtgggcattcttcactcgcctacaaggggtaaacaaggctaccagaacttgaatttgacttatagggagctacccaggaaggggaaagcccttgggactttttccaaaacaatcttctatttgaactgttcatcagccaaagtagtccactgaggtgacaaagctttcagaaatacaaagatgggaagataaaggtaacactggcccacttggggctttgacattggattgggtggactgaataaacacagcctaggtggcctgggcttgagcctcacttacttctccttgatacatagttcctggtctaccttctgaccctttttctaaaatagccagtgtctatttcactaggccatttacttacaagttcccagcttttagggaaaaaagagggaggggggagcatctagttttgaattagatatacatcttagaagtaatgagctattggcagctgttaaatcagattcagccacaaaccagaattctttcttgttgaacaagaccaatgagttagatgactttaataattccacttttctctccctctcttctcctcttcctgaaatcagagagatgagaaactactctttgaaatacctccagaggcgttttattgtgttcctttcccctccaagcagctccctttatacaattttgctcaggcaaccaaggacagagtatcggcagaaacatggagtgcttttgtataggccacctgtacataaaagtgtaattatttatttaattttcccatttgtatcatattaaagctttgtacagtgttttaagttctgttttaaaattattttgtattttatttttataacctagtaataaaatattcattccgcatgcaaaatctagttctgtttgtgtgatggtctggatttcaaaagtggaaaatatttttctaatttaataaagttattgaatacaccagatgttacaagatcaacggggagcagatagtgttactgtaaatgcagtaccacatctagaagttccctagaaaaagcagcccaggactgaatagaagctaggtgttaagtgtccctgcagttaggagatgttttcctgtaataaaattaaaatattaaaa

SEQ ID NO: 189400 - DNA, 520 bp, Homo sapiens
  Payload ID: 17400
  Gene Symbol: TTBK2
  Gene Name: tau tubulin kinase 2
  ENST ID: ENST00000566931
  CDS Start-End: 269-520
ccgccagtaaacgcggacggtaccccaggggactacccagccggccggccctggaagccgcgctcgggtcccgccgcagtcggcggtgggggatgggcaggcagtggcggtcccgcctgccgagggttaacccccgccggtcccggtcctgagctggaccagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcatt

SEQ ID NO: 189401 - DNA, 743 bp, Homo sapiens
  Payload ID: 17400
  Gene Symbol: TTBK2
  Gene Name: tau tubulin kinase 2
  ENST ID: ENST00000564431
  CDS Start-End: 392-743
ggcgatgggagcggtggggacgaggcggcggcggcggcaggagggggagcaggtgctggcacaagagcagcggcttgggggagccggcagcagcagtaacagcagcagcagccgccgccgccgccgccagtaaacgcggacggtaccccaggggactacccagccggccggccctggaagccgcgctcgggtcccgccgcagtcggcggtgggggatgggcaggcagtggcggtcccgcctgccgagggttaacccccgccggtcccggtcctgagctggaccagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgggaaaatgttgcactgaaggtggaatcagctcaacaaccaaaacaagttctgaaaatggaagttgctgttttgaaaaagctgcaagggtcggaatctggcagatcttcgccgtagccagtcccgaggcacattcaccattagtaccactctccggctgggtagacagattttggagtctattgaaagcattcattctgtgggattcttgcatcgagacatcaaaccgtcgaacttcgctatgggtcgctttcctagtacatgtaggaaatgttacatgcttga

SEQ ID NO: 189402 - DNA, 1961 bp, Homo sapiens
  Payload ID: 17400
  Gene Symbol: TTBK2
  Gene Name: tau tubulin kinase 2
  Uniprot ID: Q6IQ55
  ENST ID: ENST00000567840
  CDS Start-End: 440-1876
agaataacgtcgggtcgggtcagcgggctctgcagtagtcgccgcagcggcgatgggagcggtggggacgaggcggcggcggcggcaggagggggagcaggtgctggcacaagagcagcggcttgggggagccggcagcagcagtaacagcagcagcagccgccgccgccgccgccagtaaacgcggacggtaccccaggggactacccagccggccggccctggaagccgcgctcgggtcccgccgcagtcggcggtgggggatgggcaggcagtggcggtcccgcctgccgagggttaacccccgccggtcccggtcctgagctggaccagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgttgagaaagattgggggtgggggctttggagaaatttacgatgccttggacatgctcaccagggaaaatgttgcactgaaggtggaatcagctcaacaaccaaaacaagttctgaaaatggaagttgctgttttgaaaaagctgcaagggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcattctgtgggattcttgcatcgagacatcaaaccgtcgaacttcgctatgggtcgctttcctagtacatgtaggaaatgttacatgcttgattttggcttggctcgacaatttaccaattcctgtggtgacgtcagaccacctcgagctgtggcaggttttcgagggacagttcgttatgcatcaatcaacgcacatcggaacagggaaatgggaagacatgatgacctttggtccttattctacatgttggtggagtttgtggttggtcagctgccctggagaaaaataaaggacaaggagcaagtaggctctattaaggagagatatgaccacaggctcatgttgaaacatctccctccagaattcagcatctttctagaccatatctcttctttggattattttacaaaaccagactaccagcttcttacatccgtgtttgacaatagcatcaagacttttggagtaattgagagtgacccttttgactgggagaagactggaaatgatggctccctaacaaccaccactacttctaccacccctcagttgcacactcgcttgacccctgctgcaattggaattgccaatgctactcccatccctggagacttgcttcgagaaaatacagatgaggtatttccagatgaacagcttagcgatggagaaaatggcatccctgttggtgtgtcaccagataaattgcctggatctctgggacacccccgtccccaggagaaggatgtttgggaagagatggatgccaacaaaaacaagataaagcttggaatttgtaaggctgctactgaagaggagaacagccatggccaggcaaatggtcttctcaatgctccaagccttgggtcaccaattcgtgtccgctcagagattactcagccagacagagatattccactggtgcgaaagttacgttccattcacagctttgagctggaaaaacgtctgaccctggagccaaagccagacactgacaagttccttgagacctggtataaaatagtgtatttttctttttaaagcttctaaggtaccattattattgttgtcattgttgttattattattgtatatttctgttacataaagtctttcaaataagaaa

SEQ ID NO: 189403 - DNA, 556 bp, Homo sapiens
  Payload ID: 17400
  Gene Symbol: TTBK2
  Gene Name: tau tubulin kinase 2
  ENST ID: ENST00000562880
  CDS Start-End: 128-556
ttgaactcctggcctcaggcagtcttcccacctcaacttcccaaagttctgggattacaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgttgagaaagattgggggtgggggctttggagaaatttacgatgccttggacatgctcaccagggaaaatgttgcactgaaggtggaatcagctcaacaaccaaaacaagttctgaaaatggaagttgctgttttgaaaaagctgcaagggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcattctgtgggattcttgcatcgagacatcaaa

SEQ ID NO: 189404 - DNA, 1777 bp, Homo sapiens
  Payload ID: 17400
  Gene Symbol: TTBK2
  Gene Name: tau tubulin kinase 2
  ENST ID: ENST00000567274
  CDS Start-End: 393-1724
cggcgatgggagcggtggggacgaggcggcggcggcggcaggagggggagcaggtgctggcacaagagcagcggcttgggggagccggcagcagcagtaacagcagcagcagccgccgccgccgccgccagtaaacgcggacggtaccccaggggactacccagccggccggccctggaagccgcgctcgggtcccgccgcagtcggcggtgggggatgggcaggcagtggcggtcccgcctgccgagggttaacccccgccggtcccggtcctgagctggaccagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgttgagaaagattgggggtgggggctttggagaaatttacgatgccttggacatgctcaccagggaaaatgttgcactgaaggtggaatcagctcaacaaccaaaacaagttctgaaaatggaagttgctgttttgaaaaagctgcaagggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcattctgtgggattcttgcatcgagacatcaaaccgcctcgagctgtggcaggttttcgagggacagttcgttatgcatcaatcaacgcacatcggaacagggaaatgggaagacatgatgacctttggtccttattctacatgttggtggagtttgtggttggtcagctgccctggagaaaaataaaggacaaggagcaagtaggctctattaaggagagatatgaccacaggctcatgttgaaacatctccctccagaattcagcatctttctagaccatatctcttctttggattattttacaaaaccagactaccagcttcttacatccgtgtttgacaatagcatcaagacttttggagtaattgagagtgacccttttgactgggagaagactggaaatgatggctccctaacaaccaccactacttctaccacccctcagttgcacactcgcttgacccctgctgcaattggaattgccaatgctactcccatccctggagacttgcttcgagaaaatacagatgaggtatttccagatgaacagcttagcgatggagaaaatggcatccctgttggtgtgtcaccagataaattgcctggatctctgggacacccccgtccccaggagaaggatgtttgggaagagatggatgccaacaaaaacaagataaagcttggaatttgtaaggctgctactgaagaggagaacagccatggccaggcaaatggtcttctcaatgctccaagccttgggtcaccaattcgtgtccgctcagagattactcagccagacagagatattccactggtgcgaaagttacgttccattcacagctttgagctggaaaaacgtctgaccctggagccaaagccagacactgacaagttccttgagacctggtataaaatagtgtatttttctttttaaagcttctaaggtaccattattattgttgtcattgttgttattattattgtata

SEQ ID NO: 189405 - DNA, 6891 bp, Homo sapiens
  Payload ID: 17400
  Gene Symbol: TTBK2
  Gene Name: tau tubulin kinase 2
  ENST ID: ENST00000622375
  CDS Start-End: 499-5448
agaataacgtcgggtcgggtcagcgggctctgcagtagtcgccgcagcggcgatgggagcggtggggacgaggcggcggcggcggcaggagggggagcaggtgctggcacaagagcagcggcttgggggagccggcagcagcagtaacagcagcagcagccgccgccgccgccgccagtaaacgcggacggtaccccaggggactacccagccggccggccctggaagccgcgctcgggtcccgccgcagtcggcggtgggggatgggcaggcagtggcggtcccgcctgccgagggttaacccccgccggtcccggtcctgagctggaccagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgttgagaaagattgggggtgggggctttggagaaatttacgatgccttggacatgctcaccagggaaaatgttgcactgaaggtggaatcagctcaacaaccaaaacaagttctgaaaatggaagttgctgttttgaaaaagctgcaaggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcattctgtgggattcttgcatcgagacatcaaaccgtcgaacttcgctatgggtcgctttcctagtacatgtaggaaatgttacatgcttgattttggcttggctcgacaatttaccaattcctgtggtgacgtcagaccacctcgagctgtggcaggttttcgagggacagttcgttatgcatcaatcaacgcacatcggaacagggaaatgggaagacatgatgacctttggtccttattctacatgttggtggagtttgtggttggtcagctgccctggagaaaaataaaggacaaggagcaagtaggctctattaaggagagatatgaccacaggctcatgttgaaacatctccctccagaattcagcatctttctagaccatatctcttctttggattattttacaaaaccagactaccagatgtccatcagggtgacccggaagtcctacaaggtgtccacctctggcccccaggcctttaacagcctctcctacacgagtgggcctggtgcctgcatcagctcctcgagcttctcccgaatgggcagcagcagcttccggggtggcctgggtgcaggatatggtggggccagtggaggcatcaccaccatcactgtcaaccaaagcctgctgagccctcttaacctggaggtggaccccaacatccaggccgtgcgcacccaggaggagaagcagatcaagaccctcaacaacaagtttttctccttcatagacaaggtacggttcctggagcagcagaacaagatgcttgagaccaagtggagcctcgtgcagcagcagaagatggctcggagcaacatggacaacatgttcgagagctacatcaacaaccttaagtggcagctggagactctgggccaggagaagctgaagctggaggcggagcttggcaacatgcatgggctggtggaggacttcaggaacaagtatgaggttgagatcagtaaatgtacagagatggagaatgaatttgtgctcatcaaggagtatgtagatgaagcttacatgaacaagatggagctggagtcttccctgaaagagctgactgccaagatcagcttcctcaggcagctgtatgaagaggagatcgggagctgcagtcccagatctcggatacatctgtggtgctgttcatggacaacagccgcttcctggacatggacagcatcatccctgaggtcaaggccagagggcttccctggaggctgccacgcagataccgagcagcgtggggagctagccattaaggatgccaatgccaagctgtctgagctggaggccgccctgcagctagccagtcaagacatggcgcggcagctgcgtgagtaccaggagctgatgaacgtcaagctggccctggatatcaagatcgccacctacaggaagctgttggagggcgaggagagctggctggagtctgggatgcagaacatgagtatccatatgaagaccaccagcagctatgcaggtggtcagagcttggcctatgggggcctcacaagccctggcctcagctacggcctgggctccagctttggctctggcatgggctccagctccttcagccacaccagctcctccagggccgtggtcatgaagaagatcgaaacccgtgatgggaagctagtgtctgagtcctccaacgtcctgcccaatttgagaattactgccacacttcttacatccgtgtttgacaatagcatcaagacttttggagtaattgagagtgacccttttgactgggagaagactggaaatgatggctccctaacaaccaccactacttctaccacccctcagttgcacactcgcttgacccctgctgcaattggaattgccaatgctactcccatccctggagacttgcttcgagaaaatacagatgaggtatttccagatgaacagcttagcgatggagaaaatggcatccctgttggtgtgtcaccagataaattgcctggatctctgggacacccccgtccccaggagaaggatgtttgggaagagatggatgccaacaaaaacaagataaagcttggaatttgtaaggctgctactgaagaggagaacagccatggccaggcaaatggtcttctcaatgctccaagccttgggtcaccaattcgtgtccgctcagagattactcagccagacagagatattccactggtgcgaaagttacgttccattcacagctttgagctggaaaaacgtctgaccctggagccaaagccagacactgacaagttccttgagacctgcctggagaaaatgcagaaagataccagtgcaggaaaagaatctattctccctgctctgctgcataagccttgcgttcctgctgtgtcccgtactgaccacatctggcactatgatgaagaatatcttccagatgcctccaagcctgcttctgccaacacccctgagcaggcagatggtggtggcagcaatggatttatagctgttaacctgagctcttgcaagcaagaaattgattccaaagaatgggtgattgtggacaaggagcaggaccttcaggattttaggacaaatgaggctgtaggacataaaacaactggaagtccttctgatgaggagcctgaagtacttcaagtcctggaggcatcacctcaagatgaaaagctccagttaggtccttgggcagaaaatgatcatttaaagaaggaaacctcaggtgtggtcttagcactttctgcagagggtcctcctactgctgcttcagaacaatatacagataggctggaactccagcctggagctgctagtcagtttattgcagcgacgcccacaagtctaatggaggcgcaggcagaaggaccccttacagcgattacaattcctagaccttctgtggcatctacacagtcaacttcaggaagctttcactgtggtcagcagccagagaagaaagatcttcagcccatggagcccactgtggaactttactctccaagggaaaacttctctggcttggttgtgacagagggtgaacctcctagtggaggaagcagaacagatttggggcttcagatagatcacattggtcatgacatgttacccaacattagagaaagtaacaaatctcaagacctgggaccaaaagaacttcctgatcataatagactggttgtgagagaatttgaaaatctccctggggaaactgaagagaaaagcatccttttagagtcagataatgaagatgagaagttaagtagagggcagcattgtattgagatctcctctctcccaggagatttggtaattgtggaaaaggatcactcagctactactgaacctcttgatgtgacaaaaacacagacttttagtgtggtgccaaatcaagacaaaaataatgagataatgaagcttctgacagttggaacttcagaaatttcttccagagacattgacccacatgttgaaggtcagataggccaagtggcagaaatgcaaaaaaataagatatctaaggatgatgacatcatgagtgaagacttgccaggtcatcaaggagacctctctacttttttgcaccaagagggcaagagagagaaaatcacccctagaaatggagaactatttcattgtgtttcagagaatgaacatggtgccccaacccggaaggatatggttaggtcatcctttgtaactagacacagccgaatccctgttttagcacaagagatagactcaactttggaatcatcctctccagtttctgcaaaagaaaagctcctccaaaagaaagcctatcagccagacctagtcaagcttctggtggaaaaaagacaattcaagtccttccttggcgacctctcaagtgcctctgataaattgctagaggagaaactagctactgttcctgctcccttttgtgaggaggaagtgctcactcccttttcaagactgacagtagattctcacctgagtaggtcagctgaagatagctttctgtcacccatcatctcccagtctagaaagagcaaaattccaaggccagtttcatgggtcaacacagatcaggtcaatagctcaacttcgtctcagttctttcctcggccaccaccaggaaagccacccacgaggcctggagtagaagccaggctacgcagatataaagtcctagggagtagtaactccgactcagaccttttctcccgcctggcccaaattcttcaaaatggatctcagaaaccccggagcactactcagtgcaagagtccaggatctcctcacaatccaaaaacaccacccaagagtccagttgtccctcgcaggagtcccagtgcctctcctcgaagctcatccttgcctcgcacgtctagttcctcaccatctagggctggacggccccaccatgaccagaggagttcgtccccacatctggggagaagcaagtcacctcccagccactcaggatcttcctcctccaggaggtcctgccaacaggagcattgcaaacccagcaagaatggcctgaaaggatccggcagcctccaccaccactcagccagcactaaaaccccccaagggaagagtaagccagccagtaaactcagcagataggagccaggctgcatctctttgaaaggtgtgagatcttcctcctaaacctgatgcatgtgtgtccctgtactttctatgtaaaaaaatcagtgttgatcttctcttgcaaaagaaagtaacatgatcaattatttataagaagacataatacatgataaggaattacctaaggcaggcagcaagtagattaggaatcaatgtctttgtacaagaaggaaaaatagagcaaaaatccaagggggagaaactcattaaaatgagctctcattttttaagctgcctttgaaacaaaagagttgaggataggagatagaatggaattttaggggggttgcctaatttttttaagcctcaattcaaagattatatagcaaaagtgaaacttcttgtttgatattttcattcaaaactttcccaccctgaagagtcattgatcagatattagattatataagaagtctgttgccagggagccagtattcatgtatatttggcttgtgtgtttatttcgtgtattgagaatgaacacctttactttgcctcattcctagtaccctccctggagttcagatttttttttaaaattttgtatgtctcgtctgattcaatctctctgcttttattttatggtcctagttgtactatcaaatccaattacttttttttaggtccccctgattttttttttttagagcaagagttcttaacatattacatttttattatgaaaaataagaaagttaggtaaaggaaagaaaagtctaactagagctattttgcaggctttagtgtttagggagagaaagaaagtgtgggttaatagccttcaagatagaagatgccctttcatctctgttaagtgtcctcctttagaaacttgagtagaaggaaaactgaccagagtagactgcttccttaagtcttctgggttccaactgtttgtaatatcagcatccaagatgatacgagggaagcacaatgctttggactgtgatttgagatttagaaataaattagatatattattgaggcttagaatcctcaaactttgtattttatacatttagccaataaggaattaatatctggggaaataaatttaggcaaatatttcttttttaatgttttattacctgcttctcctgtgttttagttcaacatttgggcttcttggcctgattttcatacaatctcaatttacgaagctgtaaagaggaagatatttgttctaatctcactcttctaataggaatcaggcaaatgaaagtctaccagacttttaaaatgggctgtttttatactctctaggtgttttgtgttgtaaagaccttattaaggtcaggtaaattggtctgcttgctgttgaaatttgccttctagcaaacatatgtgctttctgtttgaccttgtgtttgctgccaaacctaatacagttgaattggg

SEQ ID NO: 189406 - DNA, 2478 bp, Homo sapiens
  Payload ID: 17401
  Gene Symbol: TAX1BP1
  Gene Name: Tax1 (human T-cell leukemia virus type I) binding protein 1
  Uniprot ID: Q86VP1
  ENST ID: ENST00000265393
  CDS Start-End: 183-2426
ggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaa

SEQ ID NO: 189407 - DNA, 2892 bp, Homo sapiens
  Payload ID: 17401
  Gene Symbol: TAX1BP1
  Gene Name: Tax1 (human T-cell leukemia virus type I) binding protein 1
  Uniprot ID: Q86VP1
  ENST ID: ENST00000396319
  CDS Start-End: 89-2458
gaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaaggtcagaattcccagagtcctcaatgtttcaaaacatgctcagagcaaaatggttatgttctcacattgtcaaatgcacaaccagttctgcaatatggtaatccttatgcatctcaggaaacaagagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagt

SEQ ID NO: 189408 - DNA, 2629 bp, Homo sapiens
  Payload ID: 17401
  Gene Symbol: TAX1BP1
  Gene Name: Tax1 (human T-cell leukemia virus type I) binding protein 1
  ENST ID: ENST00000409980
  CDS Start-End: 136-2577
ctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaacttcaattggcagagaaagacaaagaaataagtggtctgatttcacatttggaaaacctctccagggagaaggaacttaaaaggagtctagaaaatccagcagaaaggaaaatggaaggtcagaattcccagagtcctcaatgtttcaaaacatgctcagagcaaaatggttatgttctcacattgtcaaatgcacaaccagttctgcaatatggtaatccttatgcatctcaggaaacaagagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaa

SEQ ID NO: 189409 - DNA, 2221 bp, Homo sapiens
  Payload ID: 17401
  Gene Symbol: TAX1BP1
  Gene Name: Tax1 (human T-cell leukemia virus type I) binding protein 1
  ENST ID: ENST00000416801
  CDS Start-End: 131-406
aggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagt

SEQ ID NO: 189410 - DNA, 3174 bp, Homo sapiens
  Payload ID: 17401
  Gene Symbol: TAX1BP1
  Gene Name: Tax1 (human T-cell leukemia virus type I) binding protein 1
  Uniprot ID: Q86VP1
  ENST ID: ENST00000433216
  CDS Start-End: 466-2238
ggaagagaccgccccgtgggcggaagtgacgcaaggcctactgtcggctgggaggggaggtgtagccggtctttgggggtaggcggtagtggcggaagaggttcggcggctgatggcggatcaggatcggaagcctgcgtaactttctcccttgatccgggagtctttccactggattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgt

SEQ ID NO: 189411 - DNA, 570 bp, Homo sapiens
  Payload ID: 17401
  Gene Symbol: TAX1BP1
  Gene Name: Tax1 (human T-cell leukemia virus type I) binding protein 1
  ENST ID: ENST00000422800
  CDS Start-End: 275-570
aatagaatcagagggcattagaactgaaaagctcctaggagctttcagtgaacaaaacttcatagccaaaaaagcacacgactgggccaggagttcagagacagtcttggtgctcaggggtttgcagccctagccgtgtggtcactcccttgcttctctggctatttccttatctataaaatgagtgggctagtttaggccgactgagacgcagacagggatacggtactgtccatggacctctgagctgccctttccacatcgctgattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaatt

SEQ ID NO: 189412 - DNA, 641 bp, Homo sapiens
  Payload ID: 17401
  Gene Symbol: TAX1BP1
  Gene Name: Tax1 (human T-cell leukemia virus type I) binding protein 1
  ENST ID: ENST00000418691
  CDS Start-End: 228-641
acatatcctttctggtgctattgcaaggtttgtcagggttttacggcaacagaagactatgatgaattcgaatgggacacatttgcttctgtggagttacgattcaaactgaatgtccaatataggaaggcaacatatacaacaagcaaaagtgattttagaaataacagaacgcgggagaaaattcacacacggaaaatgatacggataacaaaagcagattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattct

SEQ ID NO: 189413 - DNA, 1174 bp, Homo sapiens
  Payload ID: 17401
  Gene Symbol: TAX1BP1
  Gene Name: Tax1 (human T-cell leukemia virus type I) binding protein 1
  ENST ID: ENST00000457186
  CDS Start-End: 1-981
gcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaacttcaattggcagagaaagacaaagaaataagtggtctgatttcacatttggaaaacctctccagggagaaggaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaat

SEQ ID NO: 189414 - DNA, 3365 bp, Homo sapiens
  Payload ID: 17401
  Gene Symbol: TAX1BP1
  Gene Name: Tax1 (human T-cell leukemia virus type I) binding protein 1
  Uniprot ID: Q86VP1
  ENST ID: ENST00000543117
  CDS Start-End: 186-2429
acggcaacagaagactatgatgaattcgaatgggacacatttgcttctgtggagttacgattcaaactgaatgtccaatataggaaggcaacatatacaacaagcaaaagtgattttagaaataacagaacgcgggagaaaattcacacacggaaaatgatacggataacaaaagcagattcacaatgacatcctttcaagaagtcccattgcagacttccaactttgcccatgtcatctttcaaaatgtggccaagagttaccttcctaatgcacacctggaatgtcattacaccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgagttgaaaattgagaaaaccatgaaagaaaaagaagaactgttaaagttaattgccgttctggaaaaagaaacagcacaacttcgagaacaagttgggagaatggaaagagaacttaaccatgagaaagaaagatgtgaccaactgcaagcagaacaaaagggtcttactgaagtaacacaaagcttaaaaatggaaaatgaagagtttaagaagaggttcagtgatgctacatccaaagcccatcagcttgaggaagatattgtgtcagtaacacataaagcaattgaaaaagaaaccgaattagacagtttaaaggacaaactcaagaaggcacaacatgaaagagaacaacttgaatgtcagttgaagacagagaaggatgaaaaggaactttataaggtacatttgaagaatacagaaatagaaaataccaagcttatgtcagaggtccagactttaaaaaatttagatgggaacaaagaaagcgtgattactcatttcaaagaagagattggcaggctgcagttatgtttggctgaaaaggaaaatctgcaaagaactttcctgcttacaacctcaagtaaagaagatacttgttttttaaaggagcaacttcgtaaagcagaggaacaggttcaggcaactcggcaagaagttgtctttctggctaaagaactcagtgatgctgtcaacgtacgagacagaacgatggcagacctgcatactgcacgcttggaaaacgagaaagtgaaaaagcagttagctgatgcagtggcagaacttaaactaaatgctatgaaaaaagatcaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagctaataataataatgtcttcacaaagaaaacggggaatcagcagaaagtgaatgatgcttcagtaaacacagacccagccacttctgcctctactgtagatgtaaagccatcaccttctgcagcagaggcagattttgacatagtaacaaaggggcaagtctgtgaaatgaccaaagaaattgctgacaaaacagaaaagtataataaatgtaaacaactcttgcaggatgagaaagcaaaatgcaataaatatgctgatgaacttgcaaaaatggagctgaaatggaaagaacaagtgaaaattgctgaaaatgtaaaacttgaactagctgaagtacaggacaattataaagaacttaaaaggagtctagaaaatccagcagaaaggaaaatggaagatggagcagatggtgctttttacccagatgaaatacaaaggccacctgtcagagtcccctcttggggactggaagacaatgttgtctgcagccagcctgctcgaaactttagtcggcctgatggcttagaggactctgaggatagcaaagaagatgagaatgtgcctactgctcctgatcctccaagtcaacatttacgtgggcatgggacaggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggcatgtgcagacccattttgatcagaatgttctaaattttgactagttactttttattatgagttaatatagtttagcagtaaaaaaaaaaaaaaaaaccacacctaaaatagaccactgaggagaccatagagcggatgctttcatgcaccctttactgcactttctgaccaggagctactttgagtttggtgttactaggatcagggtcagtctttggcttatcaataaattttaatctctgttaatcttacctgctttaaaaaaaagttcttgtgtgttcgtatctttatttattccctagtttgcagaactgtctgaataaaggatacaaggattatttcaatgttactgcactgaaaaacgtgtatgtattagtgtgctagattatttagcagaatattcacaagtttctgttgaccttgttgattgagcatgactactaaatattatgtaataaaaagcatttgtcataacagtcttatgaagtagttcttcgaatatagaaagttctataatttagcccatgaaatgataggtttttaattttcagaaatggagctgcatgtagaatgagatcacatgcttttatatgtgaaatattggttttagcaattaacagaaggcatactttgctaattttatggcaaaattttagaataacctgaatgattatttttaaactatcttgaagttgtatgtatatatctaatgggaaaatggaacaagagatgtcagtataattgttttcctattaaatgatctcataacaggggtgtttgtggcataaaaatcatagaatatatatcagtatcttttttacattttcctgatgagaatataaatttgaaatattctcagtaagtgattaaaagtacaatacataaacccaaatcaaagtaatgtgtttcttcagttatgtctgtgctgtatagaactgtcactaacattaaagaaagaggacacatttttcaagatctgt

SEQ ID NO: 189415 - DNA, 4020 bp, Homo sapiens
  Payload ID: 17401
  Gene Symbol: TAX1BP1
  Gene Name: Tax1 (human T-cell leukemia virus type I) binding protein 1
  ENST ID: ENST00000488564
  CDS Start-End: 1-429
ggcttttgctttgattccagctttgatgttcacaagaagtgtcccctctgtgagttaatgtttcctcctaactatgatcagagcaaatttgaagaacatgttgaaagtcactggaaggtgtgcccgatgtgcagcgagcagttccctcctgactatgaccagcaggtgtttgaaaggaactgggcaggcaaaaggcttctcttcccctccattcatgcacatggagctgaggatggcttcggagctgatggcactctctgtggtccaggactcatcgctgtccgactcctcatagtccacctcctcctcgtcatactcgctgcctgcaggacaagagaagtgcaaggactgtcaggagcgctcatctccccacaggttcacccggccacttccaggacaggagatgtggccgtggcagagcagcgctgacggcccagggagagggcactcccggcaccaggggactgcaaacacggctattcccttacaaccctggaagcaggagccctgcgttcccacctaagagaccagggcaagggcttcccaacaattcacagctaggagttggcggagcaagaacattaactcggttctatggcaacccagcctgtggctgcaaaggcacagggaagacttgctctggggccaaaaccaaaaataagcaacgatgacaggctcctcacactccccatgctagtgcctgacactcccaaatgagcagaacactgtccccttagttttatgctttactggcctagtaaatgcagaagtctccaaggtcgggggttacgttttggacttttaaggcatttctacttcagtggaatgaatttcaggtctttttctttatagatttgagctgggaaatttggaactaaaagagggttaccctcacgctagggagcaagaggcatagaaggccaggaggtctaaggataaatcgccagcggcagaatgtggggtagctcctggaagacgaagcgatcccctacacacgcagtactaggcaccgcatctgcccttcagctcatgcgacacttcctgctagggctgacccatcacagttacgcagctcagacaggaagcagggattctcttttattcctaagggctaagagctctgctgagaatcgaattgaaatacactctactgacttctttgcaagacggcagggatggagaaccacttcaacaggcagcctcttttgctcttttttaatgaggcccaaagccatttatttggagcttttgcacaatacaaccctgaaggacataattctaccgatcataaacagtgtaaaataatatgttgacaagtcctaatgcatttacaagccccgtggaataaataggaattatagcacaacattaataagaattatatggtagcaattacagttgtgaaattcatcccccaggtgtgaggctacattgcaccaggggcctgcctgggtgcttcaggggcttactctgctacatcaattatttcaacaccaaatattggcacttttattgggtttcattttaataggcattaataagattgtttgaagagccagttgcgccaggaacagggacgccggcatctgaggctcaaagttgaaaggagccaggaaggaaggaagggacctgaagtttactcagtgcctatgatgtttcaggcacactctgtgcattatctcatttaatcctccagtaaccctaggaggtggggattactgtcaccgttatacacacgagcaactgagccctcgtgaggttaaaacgcgcatgtgttctgaactcaccattaagggacggtgtgctttttccctcattgcttcccagcccccagtgccaggctcttctgaggggttcccttttaatctcctttgagttgctggctcttcaccatttaatactgagatggaattcgaagcagtctgttttgaagtctgttagaaattctcgggtggtgcagaaaaaacaatctggcaaacatgaagctttggagctaaatgtgggtttcaataaattctgctgtacttggccatagctccctaaataaagagagccggtttggaaacgcttgtaccaagtgacacagtggtaccacttggccacgttgcttggggtctgtcctggagcaaatcttgaaatctgtttttaagtagggcattgtttaagacattttactcttaaacaaatgccacatgctggcgtcctttaacttgcttgttagaaaactataaatgctatttcgcaaagctcctccagcgggacttcagaaagttagaaagactaatttatccatctaattgggctaatttgttaacctgaataccaagagccatgaaacatttagaatggggggagggtggggcacctcagaccaactgggggattaatgaagcccaacagaagagaaaacttcaaaactccactggatcaaaagcgatcagcccgaggcgttgaagcagcctacactgtctgcgtctcagggggaaggcacgtggtatccagccccaggcagggcaggaaggggacacacagcttaccctgcaagttggaacacttctgagagggaaaggtagtgtaggccgacaggtggtaagttggaactatcccaggcaaggtgggacacacaccactcggcagcagcttaccaccaagtccttgggtgaaactagtcatctccctcggttgcgacaagatggacttttgtttatatacttaattttgtcctctgacagagaacatcaacacagacctgggttcatgcctttgctttcgttaggtgaaggacaagccacttggcttttattttctctttcatgaaacaggcacaagtctcttccttgcaggttgaatttaaagatcagaatgagtgtgtatagaatacctgggataggaggacctccatagagtatgcactgaaaacatggaaggcagtgtaagcaatgccatctttgtaatcatattacatattccatataaaataagatgatctttagaaaggcctgttgtgaaaccaaacaaaataattccaaaagggttgggaatccctactagaaaaaacacaagagagactccaggaccagacaggccccatctgctttaagctcagagaaggagcaaagcacactccagcccccacctccaagaggctacagaggccaggagggagcgcagctggggctcagagcactgtgagcccaggcaagtgacgccacctctctgagcttcaaattgctcatctgtaaaatgggcgaacgcctgtgtgcactaaggctgttgtgaagaataactgagttcctgtttttaggactctggacaaaatgcctggcccatggtaggccttagagtagcacatggtaagaaaataaacaaaatgctatgtgagctgtttatctcatttactgttgccttgctctctcttgagaacagtcccctttttaaaccagaggaacatgctggggttctactacagcttttcttactgtaccccaaatgctccccttttattaaccaggcgtccacagcaccaggcggcagccagagggcctgcggtgggcagcgtaggggctgcgggactcgagtcacaggcgctcagatgctggcacccattcgcgtccctgacagggcgtggggtgtcctgcagaaaacttttgaggccaaaacacaaccgctgttagtctcctttcaaacattttggaactctagaaagaaataccctaaaactaagtcaccaaagcccctgggccagcctctgtcctctgctttatccatttcctcatgttttcccacaagaggaaaataaatcccaagctcgttcattcatcttcaattgctgcttcagctgctatctctcaacactcactgcagaatgaacaaatccccagcagtctccacacctttgctagggaactccttccccattcctggaaagcaggaggtagcaaagctgcttctcctagcaacaccctcccaagcttttactcctgcacttcaattaataaaaatcacgagcactgccccgac

SEQ ID NO: 189416 - DNA, 1377 bp, Homo sapiens
  Payload ID: 17402
  Gene Symbol: TAX1BP3
  Gene Name: Tax1 (human T-cell leukemia virus type I) binding protein 3
  Uniprot ID: O14907
  ENST ID: ENST00000225525
  CDS Start-End: 157-531
agtggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggatccttcccagaatcccttctctgaagacaagacggacaagggtatttatgtcacacgggtgtctgaaggaggccctgctgaaatcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccggctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctg

SEQ ID NO: 189417 - DNA, 1302 bp, Homo sapiens
  Payload ID: 17402
  Gene Symbol: TAX1BP3
  Gene Name: Tax1 (human T-cell leukemia virus type I) binding protein 3
  ENST ID: ENST00000611779
  CDS Start-End: 154-450
ggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggatccttcccagaatcccttctctgaagacaagacggacaaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccggctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattc

SEQ ID NO: 189418 - DNA, 5012 bp, Homo sapiens
  Payload ID: 17403
  Gene Symbol: TXLNA
  Gene Name: taxilin alpha
  Uniprot ID: P40222
  ENST ID: ENST00000373609
  CDS Start-End: 282-1922
gtgccgggaagtggctccagggagaagaggcctcttccctcacccgctgtgggagctgcgccccgaaagcctgccccggcacgtcgggctctcctgacccgccaagaccagagagccgttggcgccctccgcccgggcctgccggtccgtttattttaagaagctttgtgcgcctgctgtggggatttctgatccaggctgcgaagaatttcgaagtctggaaaatagcaactgtgtttgtttctaaaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagaccgagaccatcgaaggccacaggagaagaaaaaagccaagggtttggggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaagatgactaagaagatcaagaagctggagaaagaaaccaccatgtaccggtcccggtgggagagcagcaacaaggccctgcttgagatggctgaggagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccagggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgcctta

SEQ ID NO: 189419 - DNA, 4854 bp, Homo sapiens
  Payload ID: 17403
  Gene Symbol: TXLNA
  Gene Name: taxilin alpha
  Uniprot ID: P40222
  ENST ID: ENST00000373610
  CDS Start-End: 124-1764
gaggcgggagcaggcggctggccggcagcagttactcggggtttccggtgcgaggccagaggtggggaagccatcggacgtcggcggtgaggatcttctcctgacccagcatcgctcatcacaatgaagaaccaagacaaaaagaacggggctgccaaacaatccaatccaaaaagcagcccaggacaaccggaagcaggacccgagggagcccaggagcggcccagccaggcggctcctgcagtagaagcagaaggtcccggcagcagccaggctcctcggaagccggagggggctcaagccagaacggctcagtctggggcccttcgtgatgtctctgaggagctgagccgccaactggaagacatactgagcacatactgtgtggacaataaccaggggggccccggcgaggatggggcacagggtgagccggctgaacccgaagatgcagagaagtcccggacctatgtggcaaggaatggggagcctgaaccaactccagtagtcaatggagagaaggaaccctccaagggggatccaaacacagaagagatccggcagagtgacgaggtcggagaccgagaccatcgaaggccacaggagaagaaaaaagccaagggtttggggaaggagatcacgttgctgatgcagacattgaatactctgagtaccccagaggagaagctggctgctctgtgcaagaagtatgctgaactgctggaggagcaccggaattcacagaagcagatgaagctcctacagaaaaagcagagccagctggtgcaagagaaggaccacctgcgcggtgagcacagcaaggccgtcctggcccgcagcaagcttgagagcctatgccgtgagctgcagcggcacaaccgctccctcaaggaagaaggtgtgcagcgggcccgggaggaggaggagaagcgcaaggaggtgacctcgcacttccaggtgacactgaatgacattcagctgcagatggaacagcacaatgagcgcaactccaagctgcgccaagagaacatggagctggctgagaggctcaagaagctgattgagcagtatgagctgcgcgaggagcatatcgacaaagtcttcaaacacaaggacctacaacagcagctggtggatgccaagctccagcaggcccaggagatgctaaaggaggcagaagagcggcaccagcgggagaaggattttctcctgaaagaggcagtagagtcccagaggatgtgtgagctgatgaagcagcaagagacccacctgaagcaacagcttgccctatacacagagaagtttgaggagttccagaacacactttccaaaagcagcgaggtattcaccacattcaagcaggagatggaaaagatgactaagaagatcaagaagctggagaaagaaaccaccatgtaccggtcccggtgggagagcagcaacaaggccctgcttgagatggctgaggagaaaacagtccgggataaagaactggagggcctgcaggtaaaaatccaacggctggagaagctgtgccgggcactgcagacagagcgcaatgacctgaacaagagggtacaggacctgagtgctggtggccagggctccctcactgacagtggccctgagaggaggccagaggggcctggggctcaagcacccagctcccccagggtcacagaagcgccttgctacccaggagcaccgagcacagaagcatcaggccagactgggcctcaagagcccacctccgccagggcctagagagcctggtgttgggtcatgctgggaagggagcggcagcccagccaggcctggcccataaaaggctcccatgctgagcagcccattgctgaagccaggatgttctgacctggctggcatctggcacttgcaattttggattttgtgggtcagttttacgtacatagggcattttgcaaggccttgcaaatgcatttatacctgtaagtgtacagtgggcttgcattggggatgggggtgtgtacagatgaagtcagtggcttgtctgtgagctgaagagtcttgagaggggctgtcatctgtagctgccatcacagtgagttggcagaagtgacttgagcatttctctgtctgatttgaggctcagacccctccctgcccttcagagctcaagacaagtaatacacccaggtcttgactgcatttgtcttgtgagcagggcttgcttggtcagctcaggccctcctagctgctctggaggctcctttgattctctagacctggaaaaggtgtccctaggcagagccctggcagggcgctcagagctggggatttcctgcctggaacaagggacctggagaatgtttttgcgtgggatgatgtgctggtcaggagccccttgggcatcgcttcccctgccctttggtagtgccaggaccaggccaatgatgcttctcagtagccttatcattcacaggtgcctctctagcctgcacaaatgattgacaagagatcacccaaaggattatttctgaaggtgtttttttctttatttctttttctttttttttttttttctttttcttttttttttgcacatgacagtgtttgtattgaggaccttccaaggaagagggatgctgtagcagtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagaggcagaggtatgcaccttcccccttgaagagaggggaaaggcctacagtggcccacataattgcctgactcacacttcagctacctcttaatgcctgtggagggactggagctgctggatcccagtgtggtggtgtaggaggccacagtgagcaggtggccccagctgggtttcccaggtcaggaatgtgggccccaggcaaggtgcagcctttgctcacagctccatccatgtctagaccttcaggccagtctgcagatgaggttccctacctttttcttctcttcattgaccaaatcaaccaatcactacagctgctctgcttctgctttccaaagtagcccaggtcctgggccagatgcaggggaggtgcctatccatgagtgaaggccagtgtcttcctcacctgggtgggtcccacacttgtgacctcagttttaggaccaagatctgtgttggtttcttagattgctagcttttcctccaggggaccacagcaggtgaagctcaagagcgcatggctctgctaatagtaaattgttttcagggccttgtccagctgagagcttcatgtccaccagattctgagaggtgtcagcagcactttttttttttatttgttgtttgttttccatgaggttatcggaccatgggctgagctcaggcactttctgtaggagactgttatttctgtaaagatggttatttaaccctcctccaccccatcacggtggccctgagggctgacccggaggccagtggagctgcctggtgtccacgggggagggccaaggcctgctgagctgattctccagctgctgccccagcctttccgccttgcacagcacagaggtggtcaccccagggacagccaggcacctgctcctcttgcccttcctgggggaagggagctgccttctgtccctgtaactgctttccttatggcccagcccggccactcagacttgtttgaagctgcactggcagcttttttgtctcctttgggtattcacaacagccagggacttgattttgatgtattttaaaccacattaaataaagagtctgttgcctta

SEQ ID NO: 189420 - DNA, 4753 bp, Homo sapiens
  Payload ID: 17404
  Gene Symbol: TXLNB
  Gene Name: taxilin beta
  Uniprot ID: Q8N3L3
  ENST ID: ENST00000358430
  CDS Start-End: 234-2288
cagactgctgcctccatcagtgcctgtggcgtgtgtgtgtgtgtgtgtgtgtgcgcgcgcgtgcgtgcacgtgtgtatgtgtgtgtgtgtgtattgggtttctctctcccttgtaagaacacagccagcccgccctctcctgctgttgctgcagctctgacttgctttttcctgcctccttcctctcctctctcttcttgcttagcttcttgccttctgatactactcccaagatggaggctaatcactctgaacagctctcagcggaacgacagtcaacacctccaggtgacagttcatcattacccagtcacaatggcctggagaaggaagatggccaggattctccaaccccagtccaaccaccagagaaagaggcaagtgtgcaccccgatatctctgaagagctgaatcgacagctggaagacatcattaacacttatgggtctgctgccagcacagcagggaaagagggctctgccagggccagtgagcagcctgagaatgcagaatcacctgacaacgaggatggggactgtgaggaaacaactgaagaggctggaagagaacccgttgcttctggagagccacccactgtcaaagagcccgtcagcaataaggagcaaaaattggaaaagaaaatcctaaaaggattaggcaaagaagccaacctgctaatgcaaaatctgaacaagttgcaaacaccggaagaaaagtttgattttttattcaagaagtatgctgaattgctggatgaacatcgtactgagcaaaagaagttaaagctcctccaaaagaaacaggtacaaattcaaaaagaaaaggaccagttacaaggtgaacacagcagagctatcctcgctcgaagcaaattggagagtctgtgccgggagctgcagagacacaacaagactctgaaggaagaggcgcttcagcgggcacgtgaggaagaagagaaaaggaaggaaatcacaagccatttccagagtaccctcacggacatccagggccagatcgagcagcagagtgagcgaaatatgaagctctgtcaggagaacacagagcttgcagaaaagctgaaaagcatcatcgatcagtatgagctcagagaggagcatctggacaaaatatttaaacacagagaactgcagcagaagctggtggatgcaaagcttgagcaggcccaagaaatgatgaaggaagcggaggagcgacacaaacgagaaaaggaatatttgctgaaccaggcagcagagtggaaacttcaggcgaaagtgctgaaggagcaagagacagtcctgcaggctcagctcactctctactcaggaaggtttgaagaattccagagcacactaactaaaagcaacgaggtgtttgccacgttcaaacaggaaatggacaaaacaactaagaaaatgaagaagctggaaaaggacacagccacatggaaagcccgatttgagaactgtaacaaagctctgttggacatgattgaagagaaagcactgagagctaaagaatatgagtgctttgtgatgaaaatcgggaggctagagaacctctgccgtgctttacaagaagagagaaacgaactccacaaaaaaatcagagacgcagaaatatctgaaaaggatgaccaaagtcagcacaactccgatgaagagccagagtcaaacgtctctgtggatcaagagattgacgcagaggaggttaatagtgtccaaaccgccgtgaaaaatctggccacagccttcatgataattcatcatccagagtcaaccccgcaccagtccaaagaaacccaacccgaaataggcagttctcaggagagtgctgacgccgctctcaaggagccagagcaaccccctctgatcccttcacgggattcagagagtcccctgcctcccctaactcctcaggctgaagccgaaggaggcagtgatgctgaacctccctccaaggccagtaattctcctgccgggttgggagcagaaacccaatgcgagggtctccctgttggagcacaggctgatcaggcgtcctggaagccagaggcagaagcttccggtcaggccccacaggctcccaccgaggcctccctacagaagatggaggcagatgtgcctgctccagcatgcgcagcagaagagcacgttgcagccatggtgcctgcatgcgagcccagtaggcagcccccacgagcagcagcagaggagctgccagtaggggcctcagctgggccccagccgcgcaacgtggctgacaccaatctggaaggcgtcgactaagcctcaccgtgccttcagaggcttcttcctgcctctttgcatattcagcataacagcttgtcttccgaaaaaggcattaagggctagagatgtcaaatggaagagacttaggatcaagacattttttaatgttaggcagaacacattcattcagactttgctatttgttgtcaatttatagctgatttgaaggttttctatttaacactggttgacagtataattttcccaaagggcaacaaaacatacagatagcaaatttatattccttttctgttaagataatacttaaatttgttaatcaccagtaagatttgatgtttaaagacttccactgcaatatataaatactgaaaatgtgatgttctgcttatttggatatatagtttaacaagttccatagtaatttatggatgcccaggttacatttaaactatacatatacataatatatacatacgtgtgtacttattatatgtatatatacacgtatgtatagatgtgtgaatatttgtttatatacatatatgcacgtatctatatgtatatataaatgcattattacacatacatttctctcaccccttaatgcatttttctcaatgcagaatatttagatgctaatcaaaaaaatgatctcttacttgcacttgagactatggttgactaatgctctataaatccgaagagagttcggactataagtatttaggctatcattatgttgggcaaaaataagtaacccaatggtagataaatgaattcaaccagttgatcaaatggcagaaaagcagttagactacaatctgtgcagacagcatggacacaaagatgaccacaaggggcccaaaacagaaaagagaaacacaagctcacctcttggagctgcttctcctacacttctcagcccattgctttgccaccccctcatgtgccagggcatcccattccaggcttcctgcaaggaaacggttggaagtgggaaaggggagctagggattgaggggttaagggacctcacactaagaaggggctgtgctttgatcccctgcctcttgcactaccaatgtctcaagacataatattcatctcttgctgtcagacccattctatattctaaaagcttctgctccttccttcccaatttctcctttgtagcaggaaattacacccagccctcatctcaattaatgctaaataaagctattgtttttccaaaacacaaatctacactgggtctcaatatcagtgatgaggcttacaaaccaacacgttttctgccatgaggatttctctttaggccagaagtacaaaacaaaaaaaccaatggattttaaccaaaatgatttgaaatataggtgaggattcaggagaaggcaaaagctagaaacacttggggttgtcaacatgagtattacattaacattgcttgatgagaacctctaatgatactgacaacataaattacctagggtaaaggatagctgcaacaatgaaacaggaaagaagagagggagagagaggaaagggaaggaagaaaggaaggagggagaagggaagaaagaaacaatgtctaacccaaccctatcttgaaagttgaactcaagtagaaaaatggatagaaacaaaattctctagtactcatccaggaaaccattcttcaatgttgcatgtggctgtttgccaaggcacacaaagtgcttgtaggcagcaaccatatgctacaagaattgtaaactgcatacagtttgtttgaagtagacagtgaggataataacaaagttgctaggcaggaaaaaaaatcaggaaaaaagcttgtcgctatttgagaatctgtatatttttaaaggcttaaaatattataaccacagggtatccagccaaattcaacattactgcaagtcttagagatttaaacattcatttgattcagagctaaatattcaccataatccaggagggtctccttccccactgcagaggcagaacgtccaagaatggagtaagattagtcatagtaaagtctcagtctgaatatttagcaagagaaacaggcagcagaggaacccaaaggcagtaaatcaaatattctaaaacccaaagttcattattttcatccaaaagactttcacagaaacacattactcacagccatgtatatcttggacagagtttcagatggaatgacttgtctgaaatttgtaaagcttaatataggttttgggggaattattttaatattcaaagaatgttttattatagtcctttgtgttaaaatttagccttactaattataacaataactcataaagttctaaattcagaaggaatgtctgttctttatcaagtgtatgtaactattttttagaaatgccatctactttctagaaacactaaagttattgttttctaagttaaataactataatttatatatctattaaaaaggtacttctcttcccaaa

SEQ ID NO: 189421 - DNA, 398 bp, Homo sapiens
  Payload ID: 17404
  Gene Symbol: TXLNB
  Gene Name: taxilin beta
  ENST ID: ENST00000367652
  CDS Start-End: 1-398
gtatgagctcagagaggagcatctggacaaaatatttaaacacagagaactgcagcagaagctggtggatgcaaagcttgagcaggcccaagaaatgatgaaggaagcggaggagcgacacaaacgagaaaaggaatatttgctgaaccaggcagcagagtggaaacttcaggcgaaagtgctgaaggagcaagagacagtcctgcaggctcaggtgaggccaggtggacgaggcatgggggtgctgtcctcactgtccccagataaaaaggctggggccaaaggtgggcagcagaagtcctcctatgtggcaggggatggggggatgggaattggaaatgaagaacaacttcacatttattcatattttcaagtaaaaataaaagcacaatattata

SEQ ID NO: 189422 - DNA, 4401 bp, Homo sapiens
  Payload ID: 17405
  Gene Symbol: TXLNG
  Gene Name: taxilin gamma
  Uniprot ID: Q9NUQ3
  ENST ID: ENST00000380122
  CDS Start-End: 62-1648
aaggccctgcgagattctgtgccccttgtcgggccgcttgtttggctgctgccgtcacctcatggcgacgcgggtagaggaggcagcgcggggaagaggcggcggcgccgaagaggcgactgaggccggacggggcggacggcgacgcagcccgcggcagaagtttgaaattggcacaatggaagaagctggaatttgtgggctaggggtgaaagcagatatgttgtgtaactctcaatcaaatgatattcttcaacatcaaggctcaaattgtggtggcacaagtaacaagcattcattggaagaggatgaaggcagtgactttataacagagaacaggaatttggtgagcccagcatactgcacgcaagaatcaagagaggaaatccctgggggagaagctcgaacagatccccctgatggtcagcaagattcagagtgcaacaggaacaaagaaaaaactttaggaaaagaagttttattactgatgcaagccctaaacaccctttcaaccccagaggagaagctggcagctctctgtaagaaatatgctgatcttctggaggagagcaggagtgttcagaagcaaatgaagatcctgcagaagaagcaagcccagattgtgaaagagaaagttcacttgcagagtgaacatagcaaggctatcttggcaagaagcaagctagaatctctttgcagagaacttcagcgtcacaataagacgttaaaggaggaaaatatgcagcaggcacgagaggaagaagaacgacgtaaagaagcaactgcacatttccagattaccttaaatgaaattcaagcccagctggagcagcatgacatccacaacgccaaactccgacaggaaaacattgagctgggggagaagctaaagaagctcatcgaacagtacgcactgagggaagagcacattgataaggtgttcaaacataaggaactgcaacagcagctcgtggatgccaaactgcagcaaacgacacaactgataaaagaagctgatgaaaaacatcagagagagagagagtttttattaaaagaagcgacagaatcgaggcacaaatacgaacaaatgaaacagcaagaagtacaactaaaacagcagctttctctttatatggataagtttgaagaattccagactaccatggcaaaaagcaatgaactgtttacaaccttcagacaggaaatggaaaagatgacaaagaaaattaaaaaactggaaaaagaaacaataatttggcgtaccaaatgggaaaacaataataaagcacttctgcaaatggctgaagagaaaacagtccgtgataaagagtacaaggcccttcaaataaaactggaacggttagagaagctgtgcagggctcttcagacagaaaggaatgagctcaatgagaaggtggaagtcctgaaagagcaggtatccatcaaagcggccatcaaagcggcgaacagggatttagcaacacctgtgatgcagccctgtactgccctggattctcacaaggagctgaacacttcctcgaaaagagccctgggagcgcacctggaggctgagcccaagagtcagagaagcgctgtgcaaaagcccccgtccacaggctctgctccggccatcgagtcggttgactaagatgaggtgtgatcactgtattgagagatatattttgtgtataactttctctgttagtagttaactattggttttgtggtgaaaattttcttactttttctaccatatctgtattttcttagaactactggacttatgtggtacaggaggctgcttagcagttttgaatagtttaatctataaattttcctcagctgtgttgcacatcagcctcgttctccctccactggaatgcatgtgttcattgccttgtcctttctctccctgctccttgcacattatcatcctaatgaaaatttcactgacagggccgaccattacaagggaactttgttctgacgatggttccttgatgtgaaaacaatattaatttaaacgtcttagcccccccccccataatattattcagaaaaacaaaataccaaggcgattagttttgtctaataacccatttaaatgccaagtaaaaataaaactcctagtgttgggtcagaagcatatttgattgaaattagctttttgaaaacatttatatctcgggacaaattgagatggccacatgcctagaatcctaagtttcggcagaatatgtatataaagatgtcacttgtggacaaaatagtacatagaggcaaatcactagacaaataagcttagtgtttacgtgactgaacagtcatcctgctttggtttcaggtgtgggatttggaccatgaggggctcccgtagaggatggcggtttgtgtttgattctgatttgggatttcagtacatattctccacttcccatagaaggccacttattctttgaaaactggtgttcatgtttgccgttcaatgaagtcccttgtcaaagacaaggacggtcaattcacgtgtcactttcactaggcagaagtttctccaataccttctggctacttgaaagttactacaaaaattccaccagcaaagtactccaggtttttcaaaagggaattttcattatggatcagtaccaaccgaaattgattttcatttccaaaacaaacactggcaccaacatttttactttgggaagacttggcagagtgttagtcatgatctgttacttacgtgttcagtctgttttctcacccccttcttagttaccatctcttttttaagaagaaaaaagaaaagccacagtattatcaaggtctctacacttggactgggggaaaatttgaaattaagcacataacttttgaattagttctttgtttcaatgttgaatgtggcgcagttatgcagatgattaatcaggctgcactgatggaagttttgactttgtccctggtataatttgcattgaaatgctttatgaaataaaaggttctactagaactgatgttagcacattccactgagcaaaactatcagactgacacttgttaaattgcttactggactgaataaactctgttttgtccagttaaaagggttttctctttgttacaagtgttatttgtaaagtcctgtcacattcatggtcgaaactgggttgaaagaattgaaaattgtccaacagatagatagataggaaaccgcctggagtggaggagggttgtatctaagcctccactatcagtcatgttaattcaaggggccacagtggaggaaaataaatccacaaagtagattatctaattaccatcaaaatgagtcagaagcaaaaaacaccaccctccaacagcctcttaggagtacaccctgttctgctactaaaatactagactcatttccctggtggtgggggggaatgcaggtatagatcagaaatataatccaccttaaaattagtactaatgatcacattatttcacaagaactctgctggatgtacagctcttaacattttattaagccatttgtgtagcccaccacgtttctttgtggtgcttgtcctgtgtggaagattgtaaatcttgggcctgttgcatacttccaagggctttaaagcaatgtgattaacagtacttggcctgctgcttttggcttactttgtatttttagctagatgctattatagtgttgaaaggatatggattctgtctgggatgcatttgttgtcctttcagaacccttcctcccattaccctgtgaataaaaacaaatgggaccccctgagaaggacatcttcctacagtgatcacctcaccagcccagtgttgtggctttgtagcgcaccccgtatctaccatattctagaacactgtaatgctactaggctggcccagaaaaggtttaaatgttgaattcacttaaattgcaattgttgcaccatcatggaatcgtgatgtgtattatttatattggcggtggactccaaggtgtagagaaaacttgggtcttgggtaatatggaccatttcatcctcagacttgttaggagtacatttcttggtcttgagaccagtatttttcagttatgtatgcaactgcctttattacacctggttatcacaattcaattctcaggtgttgcagaaaaatctacctctttcagactgtagatggaaataactgtgaaaaaaatgatgcagatatcttctagtttgtgctaaacacactgctttatttttacagcccacgtctttcatgaggatacgaattgttaagaggcagtctcgttttgcttttcaaagacattttgtagagatttttcactaatgtgaatctgattttatctacttgattctgtatagattaagtaaatatgtatgataaacttaa

SEQ ID NO: 189423 - DNA, 3998 bp, Homo sapiens
  Payload ID: 17405
  Gene Symbol: TXLNG
  Gene Name: taxilin gamma
  Uniprot ID: Q9NUQ3
  ENST ID: ENST00000398155
  CDS Start-End: 57-1247
cctgcgagattctgtgccccttgtcgggccgcttgtttggctgctgccgtcacctcatggcgacgcgggtagaggaggcagcgcggggaagaggcggcggcgccgaagaggcgactgaggccggacggggcggacggcgacgcagcccgcggcagaagctggaggagagcaggagtgttcagaagcaaatgaagatcctgcagaagaagcaagcccagattgtgaaagagaaagttcacttgcagagtgaacatagcaaggctatcttggcaagaagcaagctagaatctctttgcagagaacttcagcgtcacaataagacgttaaaggaggaaaatatgcagcaggcacgagaggaagaagaacgacgtaaagaagcaactgcacatttccagattaccttaaatgaaattcaagcccagctggagcagcatgacatccacaacgccaaactccgacaggaaaacattgagctgggggagaagctaaagaagctcatcgaacagtacgcactgagggaagagcacattgataaggtgttcaaacataaggaactgcaacagcagctcgtggatgccaaactgcagcaaacgacacaactgataaaagaagctgatgaaaaacatcagagagagagagagtttttattaaaagaagcgacagaatcgaggcacaaatacgaacaaatgaaacagcaagaagtacaactaaaacagcagctttctctttatatggataagtttgaagaattccagactaccatggcaaaaagcaatgaactgtttacaaccttcagacaggaaatggaaaagatgacaaagaaaattaaaaaactggaaaaagaaacaataatttggcgtaccaaatgggaaaacaataataaagcacttctgcaaatggctgaagagaaaacagtccgtgataaagagtacaaggcccttcaaataaaactggaacggttagagaagctgtgcagggctcttcagacagaaaggaatgagctcaatgagaaggtggaagtcctgaaagagcaggtatccatcaaagcggccatcaaagcggcgaacagggatttagcaacacctgtgatgcagccctgtactgccctggattctcacaaggagctgaacacttcctcgaaaagagccctgggagcgcacctggaggctgagcccaagagtcagagaagcgctgtgcaaaagcccccgtccacaggctctgctccggccatcgagtcggttgactaagatgaggtgtgatcactgtattgagagatatattttgtgtataactttctctgttagtagttaactattggttttgtggtgaaaattttcttactttttctaccatatctgtattttcttagaactactggacttatgtggtacaggaggctgcttagcagttttgaatagtttaatctataaattttcctcagctgtgttgcacatcagcctcgttctccctccactggaatgcatgtgttcattgccttgtcctttctctccctgctccttgcacattatcatcctaatgaaaatttcactgacagggccgaccattacaagggaactttgttctgacgatggttccttgatgtgaaaacaatattaatttaaacgtcttagcccccccccccataatattattcagaaaaacaaaataccaaggcgattagttttgtctaataacccatttaaatgccaagtaaaaataaaactcctagtgttgggtcagaagcatatttgattgaaattagctttttgaaaacatttatatctcgggacaaattgagatggccacatgcctagaatcctaagtttcggcagaatatgtatataaagatgtcacttgtggacaaaatagtacatagaggcaaatcactagacaaataagcttagtgtttacgtgactgaacagtcatcctgctttggtttcaggtgtgggatttggaccatgaggggctcccgtagaggatggcggtttgtgtttgattctgatttgggatttcagtacatattctccacttcccatagaaggccacttattctttgaaaactggtgttcatgtttgccgttcaatgaagtcccttgtcaaagacaaggacggtcaattcacgtgtcactttcactaggcagaagtttctccaataccttctggctacttgaaagttactacaaaaattccaccagcaaagtactccaggtttttcaaaagggaattttcattatggatcagtaccaaccgaaattgattttcatttccaaaacaaacactggcaccaacatttttactttgggaagacttggcagagtgttagtcatgatctgttacttacgtgttcagtctgttttctcacccccttcttagttaccatctcttttttaagaagaaaaaagaaaagccacagtattatcaaggtctctacacttggactgggggaaaatttgaaattaagcacataacttttgaattagttctttgtttcaatgttgaatgtggcgcagttatgcagatgattaatcaggctgcactgatggaagttttgactttgtccctggtataatttgcattgaaatgctttatgaaataaaaggttctactagaactgatgttagcacattccactgagcaaaactatcagactgacacttgttaaattgcttactggactgaataaactctgttttgtccagttaaaagggttttctctttgttacaagtgttatttgtaaagtcctgtcacattcatggtcgaaactgggttgaaagaattgaaaattgtccaacagatagatagataggaaaccgcctggagtggaggagggttgtatctaagcctccactatcagtcatgttaattcaaggggccacagtggaggaaaataaatccacaaagtagattatctaattaccatcaaaatgagtcagaagcaaaaaacaccaccctccaacagcctcttaggagtacaccctgttctgctactaaaatactagactcatttccctggtggtgggggggaatgcaggtatagatcagaaatataatccaccttaaaattagtactaatgatcacattatttcacaagaactctgctggatgtacagctcttaacattttattaagccatttgtgtagcccaccacgtttctttgtggtgcttgtcctgtgtggaagattgtaaatcttgggcctgttgcatacttccaagggctttaaagcaatgtgattaacagtacttggcctgctgcttttggcttactttgtatttttagctagatgctattatagtgttgaaaggatatggattctgtctgggatgcatttgttgtcctttcagaacccttcctcccattaccctgtgaataaaaacaaatgggaccccctgagaaggacatcttcctacagtgatcacctcaccagcccagtgttgtggctttgtagcgcaccccgtatctaccatattctagaacactgtaatgctactaggctggcccagaaaaggtttaaatgttgaattcacttaaattgcaattgttgcaccatcatggaatcgtgatgtgtattatttatattggcggtggactccaaggtgtagagaaaacttgggtcttgggtaatatggaccatttcatcctcagacttgttaggagtacatttcttggtcttgagaccagtatttttcagttatgtatgcaactgcctttattacacctggttatcacaattcaattctcaggtgttgcagaaaaatctacctctttcagactgtagatggaaataactgtgaaaaaaatgatgcagatatcttctagtttgtgctaaacacactgctttatttttacagcccacgtctttcatgaggatacgaattgttaagaggcagtctcgttttgcttttcaaagacattttgtagagatttttcactaatgtgaatctgattttatctacttgattctgtatagattaagtaaatatgtatgataaactt

SEQ ID NO: 189424 - DNA, 5046 bp, Homo sapiens
  Payload ID: 17406
  Gene Symbol: TLDC1
  Gene Name: TBC/LysM-associated domain containing 1
  Uniprot ID: Q6P9B6
  ENST ID: ENST00000343629
  CDS Start-End: 184-1554
tgactcctctcttgggttccgccccacacctccgcttccacgattggaccaaatgactgcccctcagcaatgttgcctggcaacagggaaggggcggctctcgagaggagcccgtgggctgctggaccggaccggacagcaccaggaagcccggcaggagaattctgccagatatcaggacagatggggaacagcagaagccgtgtggggcggagcttttgttcacagtttcttcctgaggaacaggcagagattgatcaattgtttgatgctctgtcatcagataaaaacagcccgaatgtctcatccaaatccttctctctgaaggcactacagaaccacgtcggggaagctcttcccccagagatggtcaccaggctgtatgatggcatgcggagggtcgacctgacagggaaggcgaagggacccagtgagaacgtgtcccaggagcagttcacagcatccatgtcccacctgttgaaaggaaactccgaggagaagagtctcatgattatgaaaatgatttctgccacagaaggtcccgtgaaggccagagaagtccaaaagtttacagaggatctggttggctctgtggtgcacgtgctaagccacagacaggagctgagaggctggactgggaaggaagccccagggcccaacccccgggtgcaggtgctggctgctcagctgctctctgacatgaagctgcaagatggcaagagacttctggggccccagtggctggactatgactgtgaccgagctgtgatcgaggactgggtgttcagggtcccccatgtggccatattcctgagtgtggtcatttgcaagggctttctcatcctgtgctcgtctcttgatctgactaccctggtccctgagcgtcaagtggaccagggcaggggttttgagagcatcctggatgtcctctctgtcatgtacatcaacgcccagctgcctcgggagcagcggcaccgctggtgcctgctcttttcgtctgagctccatggacacagcttctcccagctctgtggccacatcactcaccggggaccctgtgtggctgtcctcgaggaccatgacaagcatgtgttcggtgggtttgcctcttgctcttgggaggtgaagcctcagtttcaaggggacaacagatgcttcctgttctccatctgccccagcatggctgtgtacacacacacgggctacaacgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaacgcctgcagcccctcttccctcccacatggtttaactgtaatagcgtaccgcacgggtcacagcctggtagtcccacatgtgccaagaagacgccctctgaagccatgtcctgactcatgggtggatctcccagaaatagatgttttttaagttttctttttttccctacagggtcaccctcaggatctctccaagaaatcttgtgtcaaattagtaactcagtcttatactttgttcttttttaccaacgaaatcctaagcagctgagacctttcagacccccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagcattgctgggatctcaacttctctattgaggagggggttcctcccgctggggttcatatggcctcactcaggccatccctgttagaaggtggtacctgatggtctgttctgacgggtgagggacagaggcatctggatgaaaatctcgacgctttctgggaacagcttccaatggcatgggagttctgtatttaaaagcatgaactgtgtataaaatggggaaatggaggcaggagactttgaggtaacatggtctggtggtggcatgagtcctcagaaggtatttgtaataaggttccacacccagctctctcagctgtttttaaatgaatgtgtgtgaggaacagatgggaaagttgggagatctgtctacagagaagcaaagttgtggttctcttgctaacttcaaggtgagggacattgggcaccctaagtttgggaacttggttgataaatacgtatatggtccattccataaatcagtggtgagtgactggcctgggttctagacctctgggaaccagcacctgagtcacagctgtctaggcctcggtgctggcctgggttctagatctctgggaaccagtgcctgagtcacagctgtcagtgcagccatttgcccagggctgctcccgagggggatgatgggaaattcagcagtgtagactgactttaaacaagctccggtgatcctgaaatgctgaagatcgtgtaggtgggttgtggggtcagcagagctgccatctgcccacgtctggaaaacaacacacggtgagtcaccggttggccatgagatctccccacttaaaggtgctgtgagcttgtctctaagatatatacctcttccttttgtcttttgctgtaagctttgaccttttgcagatctgatgaaaatacaacctcttattgtatagtttgccttgattataagccatagtaaatcgagctgttcgcatttttgcaggccttgcattttctactgggaggttcatcaaaccttccacttagcaatagccctgactcaggcagaatgcctcataaattagccttcgaaagaaaagtgcacgctcagacagtgtgtggaggggcaggagcgtgatgcagacaaggacttagtcatgactgattttccttagccagtttgtaatggcttatggggaacattgtgagcttcctacctgacatgttggcagaagtagaatattaggatcctcaagcatctctaccgtaagtccaaagaatttaggtccctattgtcactttgttttgcaatgttttttataaaaatgcaattaaatacctcactattaaactgccatgatgcctcagttaaaaaaaaaattaaatgtccgtcagtgtctgtgccttggtgaccattgattgctgcttctgcccaggccgctgcaaaggttaggactttgtccactcacatgctttccaccctgagcttgttctaaggagagtgcagatcacgaatgcacctgcttccaggcagtgcacttagagaaaggtcactggcccgggcttgggagcctgggggatgcagctctctctgtgggcttctcttggtgcacggttctgcctctggacactcaaacctttttagggcgtgtgcagggctggggccagtggacctgacagtaccttacctggctctgagaaactcgcaatcctagtttgcacaaatgaatagtttgttcttttgtgaaaccagaatgagaattcaggttctaaggactagaggtctccctacaaatgaagacttatcagggccctagaaagtgctaggaggaaggggttaaaaaaaaaatttgtccgcgttgcaaactattataaatgattgccacattgcaagctattattttctcccaccatattttttaattaaaaaaaagtctggggccgggtgcggtggctcacgcctgtaatcccagcactttgggaggccgaggtaggcggatcacctgaggtcggaagttcgagaccagcctgaccaacatggagaaaccccatctctactaaaaatacaaaattagctgggcatggtggcacatgcctgtaatctcagctactcaggaggctgaggtagtagaattgcttgaaccagggaggcagaggttgtggtgagccgagatcgtgccattgcactctagcctgggcaacaagagtgaaactccgtttcaagaaaaaaaaaaaggctgggtgtgatggctcacgcctgtaatcccagcattttgggagcttgaggcaggccgattgcttgagcccaggagttcaagaccagcctgggcaacatggcgaaaacccatctctacaaaaaaaaatacgaaaattaaccaggcatggtaacacatgcctgtggtcctagctacttgggaggctgaggtgtgaggatcatttaggcctggaaggttgaggctgctataagctgtgattgtgccactgcactccagcctgggcaacacagcaagaccctatgtttaaaaaaaattgtgtacctggtttagaaaaaaaagataaaaggatacaacttaaagtcagtcatcttcctgcctcttctccagctattttccctcctgacaggcaaaggcactgatgcaaaaatcactcaggtctcctccctgtgacttggtgcacacctgggcatcactgtcttttacacactgatgtgtccctcgctttcttttttaaagggaggtccgtaaccacccacctgcctccctcttgtctttatggactgcgtgatgtcccaccatatggatgctctcgggcctagcgttccaccgtctgcagctggggaacattttgtttgcagctaatcattgtcatgaatatcgtttatgtgtgccttgctgtgatggtgtctgtgggataaactcttagaattggaattgttggattgagaggtatatgccttttatttagatatagatgaattaaaaaaacctcttgagctcaatttatactcaa

SEQ ID NO: 189425 - DNA, 1845 bp, Homo sapiens
  Payload ID: 17406
  Gene Symbol: TLDC1
  Gene Name: TBC/LysM-associated domain containing 1
  ENST ID: ENST00000566995
  CDS Start-End: 263-844
ccgtgggctgctggaccggaccggacagcaccaggaagcccggcagggacagtgagctgataactgttcccaggccatgtaggtggccagcacaggacaggtcaccttctggcccacaggaacttcttgcccaggctcaagctgccccttcgcacaagggcctctgggctctgagacacagacaggacttcgaagcctgtccagatgaggcagttggaatctccccagcttgtggggagaattctgccagatatcaggacagatggggaacagcagaagccgtgtggggcggagcttttgttcacagtttcttcctgaggaacaggcagagattgatcaattgtttgatgctctgtcatcagataaaaacagcccgaatgtctcatccaaatccttctctctgaaggcactacagaaccacgtcggggaagctcttcccccagagatggtcaccaggctgtatgatggcatgcggagggtcgacctgacagggaaggcgaagggacccagtgagaacgtgtcccaggagcagttcacagcatccatgtcccacctgttgaaaggaaactccgaggagaagagtctcatgattatgaaaatgatttctgccacagaaggtcccgtgaaggccagagaagtccaaaagtttacagaggatctggttggctctgtggtgcacgtgctaagccacagacaggagctgagaggctggactgggaaggaagccccagggcccaacccccgggtgcaggtgctggctgctcagctgctctctgacatgaagctgcaaggcaaagacttctggggccccagtggctggactatgactgtgaccgagctgtgatcgaggactgggtgttcagggtcccccatgtggccatattcctgagtgtggtcatttgcaagggctttctcatcctgtgctcgtctcttgatctgactaccctggtccctgagcgtcaagtggaccagggcaggggttttgagagcatcctggatgtcctctctgtcatgtacatcaacgcccagctgcctcgggagcagcggcaccgctggtgcctgctcttttcgtctgagctccatggacacagcttctcccagctctgtggccacatcactcaccggggaccctgtgtggctgtcctcgaggaccatgacaagcatgtgttcggtgggtttgcctcttgctcttgggaggtgaagcctcagtttcaaggggacaacagatgcttcctgttctccatctgccccagcatggctgtgtacacacacacgggctacaacgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaacgcctgcagcccctcttccctcccacatggtttaactgtaatagcgtaccgcacgggtcacagcctggtagtcccacatgtgccaagaagacgccctctgaagccatgtcctgactcatgggtggatctcccagaaatagatgttttttaagttttcttt

SEQ ID NO: 189426 - DNA, 1837 bp, Homo sapiens
  Payload ID: 17406
  Gene Symbol: TLDC1
  Gene Name: TBC/LysM-associated domain containing 1
  ENST ID: ENST00000570036
  CDS Start-End: 116-289
aatgttgcctggcaacagggaaggggcggctctcgagaggagcccgtgggctgctggaccggaccggacagcaccaggaagcccggcaggagaattctgccagatatcaggacagatggggaacagcagaagccgtgtggggcggagcttttgttcacagtttcttcctgaggaacaggcagagattgatcaattgtttgatgctctgtcatcagataaaaacagcccgaatgtctcatccaaatccttctctctgaaggcactacagaaaggaacctggagtagataatgaatgattcacacgacatttggggacatttctaacttgagatgaacatcagaggagagagatagcctgcctcgtgtgtctcttgaaccacgtccctcctgactgccctcccagagatggggagacagacgcggtgatgggtctgccctcctggactcgtcggtccaggaaccatgacgtgtcaggtgcaccgttgcctctagaatgtaaccacgtcggggaagctcttcccccagagatggtcaccaggctgtatgatggcatgcggagggtcgacctgacagggaaggcgaagggacccagtgagaacgtgtcccaggagcagttcacagcatccatgtcccacctgttgaaaggaaactccgaggagaagagtctcatgattatgaaaatgatttctgccacagaaggtcccgtgaaggccagagaagtccaaaagtttacagaggatctggttggctctgtggtgcacgtgctaagccacagacaggagctgagaggctggactgggaaggaagccccagggcccaacccccgggtgcaggtgctggctgctcagctgctctctgacatgaagctgcaagatggcaagagacttctggggccccagtggctggactatgactgtgaccgagctgtgatcgaggactgggtgttcagggtcccccatgtggccatattcctgagtgtggtcatttgcaagggctttctcatcctgtgctcgtctcttgatctgactaccctggtccctgagcgtcaagtggaccagggcaggggttttgagagcatcctggatgtcctctctgtcatgtacatcaacgcccagctgcctcgggagcagcggcaccgctggtgcctgctcttttcgtctgagctccatggacacagcttctcccagctctgtggccacatcactcaccggggaccctgtgtggctgtcctcgaggaccatgacaagcatgtgttcggtgggtttgcctcttgctcttgggaggtgaagcctcagtttcaaggggacaacagatgcttcctgttctccatctgccccagcatggctgtgtacacacacacgggctacaacgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaacgcctgcagcccctcttccctcccacatggtttaactgtaatagcgtaccgcacgggtcacagcct

SEQ ID NO: 189427 - DNA, 552 bp, Homo sapiens
  Payload ID: 17406
  Gene Symbol: TLDC1
  Gene Name: TBC/LysM-associated domain containing 1
  ENST ID: ENST00000565765
  CDS Start-End: 417-552
ctcgagaggagcccgtgggctgctggaccggaccggacagcaccaggaagcccggcagggacagtgagctgataactgttcccaggccatgtaggtggccagcacaggacaggtcaccttctggcccacaggaacttcttgcccaggctcaagctgccccttcgcacaagggcctctgggctctgagacacagacaggacttcgaagcctgtccagatgaggcagttggaatctccccagcttgtggggagtcttgctctgtcacccaggctggagtgcactgttgtgatcttggctcactgcgacctctgcctcctggttcaagcgatcttcccacctcagcctcctgaatagctggaactatagtcacacgccaccacacccggctgagagaattctgccagatatcaggacagatggggaacagcagaagccgtgtggggcggagcttttgttcacagtttcttcctgaggaacaggcagagattgatcaattgtttgatgctctgtcatcagataaaaacagcccgaatgtctcatccaaatccttct

SEQ ID NO: 189428 - DNA, 557 bp, Homo sapiens
  Payload ID: 17406
  Gene Symbol: TLDC1
  Gene Name: TBC/LysM-associated domain containing 1
  ENST ID: ENST00000562447
  CDS Start-End: 309-557
agcaccaggaagcccggcaggagtcttgctctgtcacccaggctggagtgcactgttgtgatcttggctcactgcgacctctgcctcctggttcaagcgatcttcccacctcagcctcctgaatagctggaactatagtcacacgccaccacacccggctgagagacggggtcttgcccttttacccaggctggagtgcagtggcacgatcatagctcactgcagccttgacgtcctgtgctcacgcgatcctcccgcctcagcctttggagcagctaggactagaattctgccagatatcaggacagatggggaacagcagaagccgtgtggggcggagcttttgttcacagtttcttcctgaggaacaggcagagattgatcaattgtttgatgctctgtcatcagataaaaacagcccgaatgtctcatccaaatccttctctctgaaggcactacagaaccacgtcggggaagctcttcccccagagatggtcaccaggctgtatgatggcatgcggagggtcgacctgacagggaaggcgaagggacccagt

SEQ ID NO: 189429 - DNA, 557 bp, Homo sapiens
  Payload ID: 17406
  Gene Symbol: TLDC1
  Gene Name: TBC/LysM-associated domain containing 1
  ENST ID: ENST00000565079
  CDS Start-End: 114-557
agtggcccattttctcttggcaggcaaggttgtgcggatatgagtgtccagtctccagcttcgtgggtgcctggaggcaggtgcggagagaattctgccagatatcaggacagatggggaacagcagaagccgtgtggggcggagcttttgttcacagtttcttcctgaggaacaggcagagattgatcaattgtttgatgctctgtcatcagataaaaacagcccgaatgtctcatccaaatccttctctctgaaggcactacagaaccacgtcggggaagctcttcccccagagatggtcaccaggctgtatgatggcatgcggagggtcgacctgacagggaaggcgaagggacccagtgagaacgtgtcccaggagcagttcacagcatccatgtcccacctgttgaaaggaaactccgaggagaagagtctcatgattatgaaaatgatttctgccacagaaggtcccgtgaaggccagagaagtccaaaagtttacagaggatctggttggctctgtggtgcacgtgctaagccacagacaggagctgaga

SEQ ID NO: 189430 - DNA, 2083 bp, Homo sapiens
  Payload ID: 17407
  Gene Symbol: TLDC2
  Gene Name: TBC/LysM-associated domain containing 2
  Uniprot ID: A0PJX2
  ENST ID: ENST00000217320
  CDS Start-End: 45-692
aggattcactcactgcccacggccggctgagcagggacaggagaatgagaggcctccgctggcgttacactcggctgcccagccaggtggaggacaccctgtctggggaggagggtaacgaagaggaagaggaggaggaggcagctccagacccagctgctgctcctgaggatcccacggtgccccagctgacagaagccagccaggttttgagtgcctcagagattcggcagctcagctttcacttcccaccaagagtcaccggccatccctggagtctggtcttctgcacgtcaagggacggtttcagcctgcagagcctgtaccggcggatggagggctgcagcgggccagtgctgctggtgctcagggaccaggacgggcagatatttggagccttctcctcctcggctatccgactcagcaaaggcttctatggtactggcgagacattcctcttctccttctccccacagctgaaggtctttaagtggactggaagcaactctttctttgtgaagggagacttggattcactgatgatgggcagtggcagtggccggtttgggctgtggttggatggagacttgttccgcgggggaagctccccttgcccgaccttcaacaacgaggtgctggcccggcaggagcagttctgcatccaggagctggaggcttggcttctcagctgacagccctgcggcaacagaattctatgattgaagcctctaaatgaattgtgcaggagagggagtttgtaaacaactgactacagacattcacattgggtcatctttaaaaagctggactctgcttttggatgcttctcggaggcgagttggattttggactgaagtactgtcgttccattcctttttttgaggtgttatgagtggggctataacatcgccatcctattaggaagagagagaaaaacaggcaatagagaaaagccagtttccatcatcttatttctgagtgaaagtctcaagtgcgcacatcctcatcttgcatatagattgcttctagctgtcctcaatccagggaaactccaaattacatatgccctgtgcttggggcaaattagaaacactacagtcttacgcaggaagagccttcatgaaaacagccactggcctctgcagagatgactgggagcagcataccactgcccacctctatggcctccttcacacaccttcacggagcacaaactctgtcctgttttcccaggagaaagacgggatgcactgaacccctagcttctctctcgcctggtcccctctgcaataaaaggcccaggtctacaagatggcaaagaaggggaggaagaacagtatgtacctgcagaatttaaatttttctctgcatcaaagctctaacgttggtcccatcagcataggctccagccaaagaagctcctccacccaaaataagggagagatccaaagggaggcgatacaatgacgtgaaaccatagaggtaagaagcaaggcctcctaatacttgactctatgctaaactgttctgaacttgtgggtagatcttctttggttacaagatgatgcacgatcttggagagcctctgttgtaccaggaatacaatgctggtgggaggattcgtgctcctcatctgcttatttgctctcagatccattcttcactcttcctctccctactctgtctcacaggagctactccggtaaattacatttctcagctcccatgcctgttggtttccagttagatttggtcagtgggaggctctggtgggagactggaggtgagaagagggcagagaagtcaggttttttctctccctacctcctctggcacgagcggcagtggcagtgactattctgtggttctagcttttgcaggtggccccagctcctggactcccacctgctcccttggtctctcctatcctagaggtggtagcagcttcctgctgttgaatcactgtcctctatgctcatttagctctgccaaaacttttgtatctcacccccatgttaaattttttctgttgaactacactggatctgacttgatagaactattaaaaatagtttttaaaaaa

SEQ ID NO: 189431 - DNA, 1448 bp, Homo sapiens
  Payload ID: 17407
  Gene Symbol: TLDC2
  Gene Name: TBC/LysM-associated domain containing 2
  ENST ID: ENST00000436941
  CDS Start-End: 1-84
gtctttaagtggactggaagcaactctttctttgtgaagggagacttggattcactgatgatgggcagtggcagaattctatgattgaagcctctaaatgaattgtgcaggagagggagtttgtaaacaactgactacagacattcacattgggtcatctttaaaaagctggactctgcttttggatgcttctcggaggcgagttggattttggactgaagtactgtcgttccattcctttttttgaggtgttatgagtggggctataacatcgccatcctattaggaagagagagaaaaacaggcaatagagaaaagccagtttccatcatcttatttctgagtgaaagtctcaagtgcgcacatcctcatcttgcatatagattgcttctagctgtcctcaatccagggaaactccaaattacatatgccctgtgcttggggcaaattagaaacactacagtcttacgcaggaagagccttcatgaaaacagccactggcctctgcagagatgactgggagcagcataccactgcccacctctatggcctccttcacacaccttcacggagcacaaactctgtcctgttttcccaggagaaagacgggatgcactgaacccctagcttctctctcgcctggtcccctctgcaataaaaggcccaggtctacaagatggcaaagaaggggaggaagaacagtatgtacctgcagaatttaaatttttctctgcatcaaagctctaacgttggtcccatcagcataggctccagccaaagaagctcctccacccaaaataagggagagatccaaagggaggcgatacaatgacgtgaaaccatagaggtaagaagcaaggcctcctaatacttgactctatgctaaactgttctgaacttgtgggtagatcttctttggttacaagatgatgcacgatcttggagagcctctgttgtaccaggaatacaatgctggtgggaggattcgtgctcctcatctgcttatttgctctcagatccattcttcactcttcctctccctactctgtctcacaggagctactccggtaaattacatttctcagctcccatgcctgttggtttccagttagatttggtcagtgggaggctctggtgggagactggaggtgagaagagggcagagaagtcaggttttttctctccctacctcctctggcacgagcggcagtggcagtgactattctgtggttctagcttttgcaggtggccccagctcctggactcccacctgctcccttggtctctcctatcctagaggtggtagcagcttcctgctgttgaatcactgtcctctatgctcatttagctctgccaaaacttttgtatctcacccccatgttaaattttttctgttgaactacactggatctgacttgatagaactattaaaaatagtttttaaaaaa

SEQ ID NO: 189432 - DNA, 1179 bp, Homo sapiens
  Payload ID: 17407
  Gene Symbol: TLDC2
  Gene Name: TBC/LysM-associated domain containing 2
  Uniprot ID: A0PJX2
  ENST ID: ENST00000602922
  CDS Start-End: 55-702
ggcagggctgaggattcactcactgcccacggccggctgagcagggacaggagaatgagaggcctccgctggcgttacactcggctgcccagccaggtggaggacaccctgtctggggaggagggtaacgaagaggaagaggaggaggaggcagctccagacccagctgctgctcctgaggatcccacggtgccccagctgacagaagccagccaggttttgagtgcctcagagattcggcagctcagctttcacttcccaccaagagtcaccggccatccctggagtctggtcttctgcacgtcaagggacggtttcagcctgcagagcctgtaccggcggatggagggctgcagcgggccagtgctgctggtgctcagggaccaggacgggcagatatttggagccttctcctcctcggctatccgactcagcaaaggcttctatggtactggcgagacattcctcttctccttctccccacagctgaaggtctttaagtggactggaagcaactctttctttgtgaagggagacttggattcactgatgatgggcagtggcagtggccggtttgggctgtggttggatggagacttgttccgcgggggaagctccccttgcccgaccttcaacaacgaggtgctggcccggcaggagcagttctgcatccaggagctggaggcttggcttctcagctgacagccctgcggcaacaggtactcagccctgctcatgatgccacccaggccttcctgacacacagcagcctgtgctgtttgaaacacagatggtgaagggccctagagttggccgaggctgctggccagcctccttgtggcctggggacccaagatacaggtgggggcaggcactgctcttttgcagaggtgactttgaaggattaaaagacgcttacaccttactcaagcagcacagagaccctaagctaacagggtcttagaaaactcagaaaaatccacatctcttccccgctagtgcctgcctcctggcaaagggaagatttttcactatgctgttcctcgccagctactgaacgaggaaaaccaacctcatgaacattatcattttagaggttctacaactgattcatgtttattgtagaaaaaccagaagacgttaaaaaaattaaaattgcctaaaattcaacccccccca

SEQ ID NO: 189433 - DNA, 5700 bp, Homo sapiens
  Payload ID: 17408
  Gene Symbol: TBC1D1
  Gene Name: TBC1 (tre-2/USP6, BUB2, cdc16) domain family, member 1
  Uniprot ID: Q86TI0
  ENST ID: ENST00000261439
  CDS Start-End: 356-3862
ctcttcggctgctgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaaaggcgtgggtccatcgttcttccgagagggtttgtgtggcgactacaccctcagcgtccctggcaaggtgcagttggctctcgcccattcttgttatggaaacctaagatgatcattgggaagatcagtgatcttgggtcattgatccctggctcagaggatagcggtttccatcataaaccaagatgatgagttcagcctttatccctcgtggttccactagatgtaacttaaaggagttaacatttgaggactttgttctacatcagattttactatttgaatgtttaagatcactttattgaatttgaagatcatcaaattaaataaaatgatttatttaatttggatatcctgatcactgtcaagtgaaatggatctctctctttggtatttaaggaagtttgtctttaaaaaaaaaatagagtgttttcatacatttttgcttatcccataagtacagttgatcaaagtcatagtaggtaaatgctttatgggacagctgacaccttttagaccctaccaggtattgctagcatgtgagctgcagttgtggggtctgagatatttctttgtggtagtttcatacccatactatagagtcatgtatttatttttgcctgttgtgtgatgtaatgcaatcatgttcctttgagtctccatcccttggaaatctgacttcttgcagaaggagtaggcacatcaagatattcaggggtgccccaagagtctgggactttcaaaaaaaaaagatcaggctgaaactgcagtcagatttatgacagctgacagtttttcagaggtcgcacacagtgactctcctctctcaggatgacgaggacctgtgccttcaacaagcaaaatgctgctcacggttgtcctgcttgcagccagtcactgtgtaaagcctctctgatgtgcacttaagagtgggttgctttctcacaaagatggggttctgtgcagtcacaggtcacttccttgacaacacaatcatttctgatctttatcactgtaaccacgtcttctattccataggagtttcttttgattctctcagttgcggggggcatctcttaatcctggggtaaaaggagagattgccatacttagactcactgtgagtctccccggccatttcacgaggagaccacagtgctgccaccagtgcctaaacaggtggctggcattcgagacttcctcctgttccctgggtcagaggatagcggtttccatcataaaccaagatgatgagttcagcctttatccctcgtggttccgctagatgtaacttataggagttaacatttgaggactttgttctgcatcagatcttactatttgaatgtttactgttggattttgggcatcttattactgttactcaaaaacattgactctgcatcaagaaagaaacaagaaagcaataaaacaagaaataattcatgctcaca

SEQ ID NO: 189434 - DNA, 1567 bp, Homo sapiens
  Payload ID: 17408
  Gene Symbol: TBC1D1
  Gene Name: TBC1 (tre-2/USP6, BUB2, cdc16) domain family, member 1
  ENST ID: ENST00000402522
  CDS Start-End: 344-778
tgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaatgctcatcatcactgtaggggacctttgaaagagctgccggagaaggtgaggaagaaagccctgcctggaaagcaacagtgaaccaccagtgtcagcaacgtgaagcttgctgcaaggcctgcagtcatgatgaacccagcagcttctagttcatcccagtggccctgagactatttatcctgtgacttcacacgcgcttggaagttttgttgtgatcttcgctgagtctgtgcggaaatcacaggctagattttagattttttacttttcagcatgtgacttaaagttctgttgacttggggaaagggctgataatcttgtgctaaatcactgatggaatataaattaaaatctccatctctcagtcaatccaagtgtccatcaatggtagactggataaagaaaatgtggtacatacacaccatggaatactatgcagccataaaaagaaacgagatcacgtcctttctaggaacatggatggagctggaaaccattatcctcagcaaactaacaaaggaagagaaaaccaaacaccacatgttctcatttataagtgggagctgaacaatgagaacacgtggacacagggaggagaacaacacacactggggcctgtcacggggcggggtgaggggagggagagcattaggaaaaacagctaatacatgctaggcttgatatctaggcgatgggttggtaggtgcagcaaaccaccatggcacacatttacctatgtaacaaacctgcacatcctgcacatgtaccctgaaacttagaaataaaaatttttcaaaagggaaaaa

SEQ ID NO: 189435 - DNA, 1987 bp, Homo sapiens
  Payload ID: 17408
  Gene Symbol: TBC1D1
  Gene Name: TBC1 (tre-2/USP6, BUB2, cdc16) domain family, member 1
  ENST ID: ENST00000446803
  CDS Start-End: 191-1987
gccccgcgggcgcgacctctcggggcagtgacgaactgggtggagcccgccgccgccgccgccgccgccggggagagcgatgccccggccccgccgctccccaagcccgcccccggccgcccgcgggcccacgggccggcggcgggagtgagcgggagccggcgggcgaagagccgccgcccggcccgcgatgtcaccattgttcagctgggtggccaaggtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctatt

SEQ ID NO: 189436 - DNA, 755 bp, Homo sapiens
  Payload ID: 17408
  Gene Symbol: TBC1D1
  Gene Name: TBC1 (tre-2/USP6, BUB2, cdc16) domain family, member 1
  ENST ID: ENST00000443855
  CDS Start-End: 1-755
aaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaatgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggcccttt

SEQ ID NO: 189437 - DNA, 679 bp, Homo sapiens
  Payload ID: 17408
  Gene Symbol: TBC1D1
  Gene Name: TBC1 (tre-2/USP6, BUB2, cdc16) domain family, member 1
  ENST ID: ENST00000421339
  CDS Start-End: 1-679
tccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagaacctcactgtggatcgccatcgttggcctgtactgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaag

SEQ ID NO: 189438 - DNA, 2977 bp, Homo sapiens
  Payload ID: 17408
  Gene Symbol: TBC1D1
  Gene Name: TBC1 (tre-2/USP6, BUB2, cdc16) domain family, member 1
  ENST ID: ENST00000510573
  CDS Start-End: 1-2569
gtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaacatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaaaggcgtgggtccatcgttcttccg

SEQ ID NO: 189439 - DNA, 4119 bp, Homo sapiens
  Payload ID: 17408
  Gene Symbol: TBC1D1
  Gene Name: TBC1 (tre-2/USP6, BUB2, cdc16) domain family, member 1
  Uniprot ID: Q86TI0
  ENST ID: ENST00000508802
  CDS Start-End: 356-3835
ctcttcggctgctgctcctggtgccgccaccgtccgccggtgcctgttgctgccgccgccgcgggacctgctgtgtcctcagctgggtggagaagaggcgggcgccgagccgaggggagccccctccccgtccccccgcggcgggaagagcgcagccagccgggtgcgatggactccccgcccgcccaggccgtccccaggatgcccccaagcacctgcgcgtcccggcccggccccgggctctgagcgcgccgcggcacaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattcacaacagtcatgacccaagttactttgcttgtctgattaaggaagacgctgtccaccggcagagtatctgctatgtgttcaaagccgatgatcaaacaaaagtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacgattggccagtctgaagtttacctcatcagtcctgacaccaaaaaaatagcattggagaaaaattttaaggagatatccttttgctctcagggcatcagacacgtggaccactttgggtttatctgtcgggagtcttccggaggtggcggctttcattttgtctgttacgtgtttcagtgcacaaatgaggctctggttgatgaaattatgatgaccctgaaacaggccttcacggtggccgcagtgcagcagacagctaaggcgccagcccagctgtgtgagggctgccccctgcaaagcctgcacaagctctgtgagaggatagagggaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaatgtggatccttcacctgtgggtgagtctaagcaccgcccaggtcagtcttcagctcctgctcctccacctcgtcttaacccctccgcctcctcgccaaacttttttaagtacctaaaacataattccagtggagaacaaagtgggaatgctgtgccaaagagcatctcctaccgtaatgccctgcggaaaaaacttcattcttcttcctctgtgccaaattttctaaaatttctggctcctgtagatgaaaataacacctctgattttatgaacacaaaaagggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgtttt

SEQ ID NO: 189440 - DNA, 530 bp, Homo sapiens
  Payload ID: 17408
  Gene Symbol: TBC1D1
  Gene Name: TBC1 (tre-2/USP6, BUB2, cdc16) domain family, member 1
  ENST ID: ENST00000513936
  CDS Start-End: 1-530
gaatgaattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcaggagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggact

SEQ ID NO: 189441 - DNA, 2383 bp, Homo sapiens
  Payload ID: 17408
  Gene Symbol: TBC1D1
  Gene Name: TBC1 (tre-2/USP6, BUB2, cdc16) domain family, member 1
  ENST ID: ENST00000615497
  CDS Start-End: 677-1975
cccaggtttctgcatatgaagtgtgtaaaatagattgcttgatccaaaacagaaaaacagtgataactgttttgctgagttcccagacccttcccaagatggaaccaataacattcacagcaaggaaacatctgctttctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccaagcaagtccggctttgcgtttcaccctctggactgagatgtgaacctgagccagggagaagtcaacagtgggatcccctgatctattccagcatctttgagtgcaagcctcagcgtgttcacaaactgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgttttcttgttggttcctttttgagtgtcactgtgtttgtaaagagcattcacaatacggtggaatttcaaaagctggaagagctcgagatcatgcctcaggcaaaggcgtgggtccatcgttcttccg

SEQ ID NO: 189442 - DNA, 8101 bp, Homo sapiens
  Payload ID: 17409
  Gene Symbol: TBCK
  Gene Name: TBC1 domain containing kinase
  Uniprot ID: Q8TEA7
  ENST ID: ENST00000273980
  CDS Start-End: 449-3130
tcctcacttctcagaccgggcagccggtcagagacgctcctcacctcccagacggggtggcggcggggcagagacactcctcagttcccagacagggtcgcggccgggcagaggcgctcttcacatctcagacggggcgacggggcagagatgctccccacatcccagatgatgggcggctgggcagagacgctcctcacttcctagacaggatgacggccgggaagaggccagggctggtcctgctgcgaacggactacccattagcagcgcaggccaggtcctctctcctggaggcaagttagagaaggaagacccctacgatcgcaatcggcgatccccgagtgagtgacccgccacgacgtcactcacatgaagcggaggaccacgggttccgagacagccacagcaggaagcatattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgagctgttcaacggttttgtgtatagcatttgaggttcttcagggcttgcagtatatgaacaaacatggtatagtacacagggcattgtctcctcataatatcctgttggaccgaaagggacatattaaattggctaaatttggactttatcacatgacagctcatggtgatgatgttgatttcccaatagggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatcaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcacccaaacaagggggatgtgtgtgtgtgtgtgtgtataggaagtggagtttatcccattgcagaaagtggtaatacttactcccagaaaaatgaaatttagaaaccatttatatttgatagaatatttggtcagttcctgtagcaaagacgaatggcttaaacaaattttctagtttctttatcacatgaaagtctgtacagtcagtccagggctagtctactggtttcctgatcattaagaactcattaccttctctcattgctttacaaacctcaatatgtggcatccatctcatggatgaaaatggctcctcagcttctaccatcacatctgctatctagaaggaagagaatgagggaaggagggaggggatgaagagaaaagaaggaacaaaagaaggagggaggaaagaagaaaagaaaggaaaagaagcgaagcacactccttccctttaaggtcataaaccagaagttgcgcacactacctctgcttacatatcattggccagaacttgggtgcatggccacacctagctttaaggaaaactggaaatagagtctttgggtggttgatcatttccccagctaaaaacattcttattactgtgtgggaagaagagagtacatattgaggtacagctaacaacctctgcctctgccacattgtttttaaaatgagtattatatttcattaaatctaagacatctcacaattttaggtaccacaaagaaaaaatgaagccaaatgaattgtgacactttgtcaattaaaagacacattccctgggaggccgaggtcaggagtttgagaccagcctggccaacatggggaaactttgtctctactaaaaatataaaaattagctggtcatagtggcacacgtctgcggtcccagctactcaggaggctgaggcaggagaatcacttgaacctgagaggcagaggttgcaatgagccatgatagggccactgtaccccagcctgggcaacagggctcaccctgccatctcaaaaaaaaaaaaaaaaagaaagatacattcccatttcagaaatctgaaaaaaaaaatgcctcatatatatgaaatatagcatatcctttaattatcttcaattttgttttaactaaaaagtgttcattcatctataacttacattccactccaatgttaagactgcctaggcagaacatttcaataagagcctcaattcagctttctgggccatggttttgttgttgctgctattgtttactttattttattttttctttgcatctactttttaaattgagatatacttaaccataaaattcatccttttaacatgtacagttcagtagtttttagtgtattcacaaagttgtgcaatcagtattatccagaatactttcattgtatgcaattgtctacctgatcagcaggtattccacattaacccctcctaaggtctttgataaatttttgtatatggagtgaggggtccaggttcattcttgcatatgagtatccagttgtcccaggacccctcctgttttgtttgttttattcaatttatttggtcattcaccaaatatgttttgaatacctactatgtatttctaagacactaatataatccatagttatatcatttgtgatccttacctagtttacaaggaaaaaaatgtgagaattaatgagaacaaatatataccaagatttcactaacattgtttttgggccattgtctaccctcttcagagaaatattaaatcctcctgtcctggcaattactattttcttccttcagtctttgatgacttacctgagttcataatcagaatgcaccattgatgatcattctgagtcttaactctgccttactgagaaagcagagaagagagggatggaggggcagtgatttgagttgaataaggtggtaggtagtaggagaggatgaagaccttgtgaagagagctatgtaagaagataatagtagcaaccctctgtcatgattttgcatttgatctttcttaaaacgacacatttaggcttattccaagaaattgaagttttttaaacatgaaaattataatatttaatattctcaacagtaaagtaagagcacactatcactgccatgtttatacacagggcatgttatttcatggtggatgatacgaacagttgacctcaacaactatttgttagattaaacgtatataacccaggatttatttgagttcctttttaatgtattattgattcctacacgatgactatcagcactgtttctggctttacctggaatgccataagtaccaccaccagcccacacagatatacatacacacacacacacacacacactcacattcataaacacacttattaactcttgataatctagcaacaacagtgtacctcctccagtcttctctggcttccccatgctgcactaagagccccaaatctactaaagcattccattcataatttactaataatagatttattacatcattttgcaatcgtttgtttacatttagtcccctattaaaatatgagctgcttaagatcaggagctataatttatacctcttgctaccttcagcaacccaccacattggatatgctcaattaatataaaattgaatctatcaattttagaatctatttgaagggagaaaaataaaaataacctgtggtaatttttttcaactgccaaacttatctggtacctgatagtatagaaataaattgaaatctcaattcatggagtgaaaaaaggatctctaaagtcccatccagctctaaaatctgataattctagaagttggagcagataacttccaaaataaggtaatttaatctagttgcatcctcttttcaaaatacagaaatgttagattcaaaaagcatattaaaaataactaatgcttaaccaagtttgaaagaaagaagttttttgatgtcagaaatgaaaaggacctgaaaggcacagcttttaggcccgtgggatacccagtatcaatataagccccaagaactcaggttttggaatacatataggaatagaagacatagctttggatcttatgggtgggagttctaattaagacctctttatgaagtgaccgtctcaaggaactccgctccatgaaatgacaagacataacttcccgccaaattagggaagctacagaggagattgtcattggcctggttattcttgatgaaggaagaaaaatctgttacagacagagttgttcagtggaaagtctggggtaagttcctgatttagaacaggctttagtgcactttaaaaggaaaacaatgaattatataaaacttttagaggacacagtggtgccagatttttgttggattcctgtgctttcctcctccaaatagttaccaaaaaatattcctttgggaattagtatcaaaaggattctatagcatctcaaaagaatcttattcactttgggaggccgaggcaggcagatcacaaggtcaggagatcgagaccatcctggctaacacggtgaaaccccatctctactaaaaatacaaaaaattagccaggcgtggtggtgggcgcctgtagtcccagctactcgggaggctgaggcaggagaatggcgtgaacccaggaggcagagcttgcagtgagccgagatcgctccactgcactccagcctgggagacagagtgagactccgtctcaaaaaagaaaaaaaaaaatcttatgcagtagtcttatttaataaaatccactacaaggagagaagactgctgccttgactatatagaaagggttggcagatatttcattctatcagttgtaactagtaatcccattgttatacatgctgacccaaaatatagctgttattaaccaaataatgcatttttcttgataaatgttgattaaatcagattggaagcaaaatggtaatatttatgatcaattttagtttggatgttcaatgtcaagaccaaaccctcttcacagctaccaacttcaattttatgtggaaaactaatggtgaagagtttcaaactttaactgacacttgacatttaacagggtatgtaattgctcacacacaacctttaggttttgtaatccagttttatctcatacaatattagaaacagtacacattgtaaatacctattttaaaagttagccatattttataaagtcacatgtatttatatcttttctgagtaattttcctgttaatgccttatgataggtgcttgtaacatgaaaactaaacttggatcttggcatattcagtgttctatagatagattgtgatctgtatagcttctacggtgactttcaggcctaatgtctccttttaagttgttattctttaatatcctttctcattcctttcagaggacctattattagtttgcattgtctgcagcatttcaataatactgttctattctaataatactgatctgttctaataaacagttctaaatac

SEQ ID NO: 189443 - DNA, 3312 bp, Homo sapiens
  Payload ID: 17409
  Gene Symbol: TBCK
  Gene Name: TBC1 domain containing kinase
  Uniprot ID: Q8TEA7
  ENST ID: ENST00000361687
  CDS Start-End: 330-2822
aggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgaggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatcaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcacccaaa

SEQ ID NO: 189444 - DNA, 3349 bp, Homo sapiens
  Payload ID: 17409
  Gene Symbol: TBCK
  Gene Name: TBC1 domain containing kinase
  Uniprot ID: Q8TEA7
  ENST ID: ENST00000394706
  CDS Start-End: 306-2870
gggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgagctgttcaacggttttgtgtatagcatttgaggttcttcagggcttgcagtatatgaacaaacatggtatagtacacagggcattgtctcctcataatatcctgttggaccgaaagggacatattaaattggctaaatttggactttatcacatgacagctcatggtgatgatgttgatttcccaatagggtatccctcgtacttggcccctgagggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatcaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactca

SEQ ID NO: 189445 - DNA, 3047 bp, Homo sapiens
  Payload ID: 17409
  Gene Symbol: TBCK
  Gene Name: TBC1 domain containing kinase
  Uniprot ID: Q8TEA7
  ENST ID: ENST00000394708
  CDS Start-End: 366-3047
agcgttgggtcgcggtggctgtgagggcggaagaaaaggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgagctgttcaacggttttgtgtatagcatttgaggttcttcagggcttgcagtatatgaacaaacatggtatagtacacagggcattgtctcctcataatatcctgttggaccgaaagggacatattaaattggctaaatttggactttatcacatgacagctcatggtgatgatgttgatttcccaatagggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatcaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatga

SEQ ID NO: 189446 - DNA, 3362 bp, Homo sapiens
  Payload ID: 17409
  Gene Symbol: TBCK
  Gene Name: TBC1 domain containing kinase
  Uniprot ID: Q8TEA7
  ENST ID: ENST00000432496
  CDS Start-End: 187-2868
attagcagcgcaggccaggtcctctctcctggaggcaagttagagaaggaagacccctacgatcgcaatcggcgatccccgagtgagtgacccgccacgacgtcactcacatgaagcggaggaccacgggttccgagacagccacagcaggaagcatattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgagctgttcaacggttttgtgtatagcatttgaggttcttcagggcttgcagtatatgaacaaacatggtatagtacacagggcattgtctcctcataatatcctgttggaccgaaagggacatattaaattggctaaatttggactttatcacatgacagctcatggtgatgatgttgatttcccaatagggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatcaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcacccaaacaag

SEQ ID NO: 189447 - DNA, 848 bp, Homo sapiens
  Payload ID: 17409
  Gene Symbol: TBCK
  Gene Name: TBC1 domain containing kinase
  ENST ID: ENST00000509532
  CDS Start-End: 370-848
agcgttgggtcgcggtggctgtgagggcggaagaaaaggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagaggcagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgagctgttcaacggttttgtgtatagcatttgaggttcttcagggcttgcagtatatgaacaaacatggtatagtacacagggcattgtctcctcataatatcctgttggaccgaaagggacatattaaattggctaaatttggactttatcacatgacagctcatggtgatgatgttgatttcccaatagggtatccctcgtacttggcccctga

SEQ ID NO: 189448 - DNA, 3566 bp, Homo sapiens
  Payload ID: 17409
  Gene Symbol: TBCK
  Gene Name: TBC1 domain containing kinase
  ENST ID: ENST00000467183
  CDS Start-End: 309-770
agagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgagctgttcaacggttttgtgtatagcatttgaggttcttcagggcttgcagtatatgaacaaacatggtatagtacacagggcattgtctcctcataatatcctgttggaccgaaagggacatattaaattggctaaatttggactttatcacatgacagctcatggtgatgatgttgatttcccaataggtatgtgaaagagaagatacttggcaagatagttttaaaatgtatgtagagaagaacaaacacctacaaagagcctgcattttcccaaagagaaactaaaaggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggccaaccccagatcaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtattggcaaggtcttgactcactttgtgctccattcctatatctaaacttcaataatgaagccttggcttatgcatgtatgtctgcttttattcccaaatacctgtataacttcttcttaaaagacaactcacatgtaatacaagagtatctgactgtcttctctcagatgattgcatttcatgatccagagctgagtaatcatctcaatgagattggtttcattccagatctctatgccatcccttggtttcttaccatgtttactcatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccagaaattgacattgaacgctgtgtgagagaatctatcaacctgttttgttggactcctaaaagtgctacttacagacagcatgctcaacctccaaagccatcttctgacagcagtggaggcagaagttcggcaccttatttctctgctgagtgtccagatcctccaaagacagatctgtcaagagaatccatcccattaaatgacctgaagtcagaagtatcaccacggatttcagcagaggacctgattgacttgtgtgagctcacagtgacaggccacttcaaaacacccagcaagaaaacaaagtccagtaaaccaaagctcctggtggttgacatccggaatagtgaagactttattcgtggtcacatttcaggaagcatcaacattccattcagtgctgccttcactgcagaaggggagcttacccagggcccttacactgctatgctccagaacttcaaagggaaggtcattgtcatcgtggggcatgtggcaaaacacacagctgagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaa

SEQ ID NO: 189449 - DNA, 897 bp, Homo sapiens
  Payload ID: 17409
  Gene Symbol: TBCK
  Gene Name: TBC1 domain containing kinase
  ENST ID: ENST00000508666
  CDS Start-End: 1-419
caaccccagatcaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggagaaagagcttgtcaacaaggaaatcattcgatccaaaccacctatctgcacactccccaattttctctttgaggatggtgaaagctttggacaaggtcgagatagaagctcgcttttagatgataccactgtgacattgtcgttatgccagctaagaaatgagcagacattctgccttcaagttggaagttgaacagcagagcagcagagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaaaatttaggcgtgtattaaaagcctgggtagtgtctcatcctgatcttgtgtatt

SEQ ID NO: 189450 - DNA, 865 bp, Homo sapiens
  Payload ID: 17409
  Gene Symbol: TBCK
  Gene Name: TBC1 domain containing kinase
  ENST ID: ENST00000503832
  CDS Start-End: 1-256
gtatccctcgtacttggcccctgaggtaattgcacagggaattttcaaaaccactgatcacatgccaagtaaaaaaccattgccttctggccccaaatcagatgtatggtctcttggaatcattttatttgagctttgtgtgatgagaaaagtgaaacttcaggtggtattaagtagtttgccaaatttatataactatttgatggtggaagagtccaatttggcacacaatcattgctcaactcataaatgctgaagggaagaaaattatttcagagcttggatatttctgaaagactaaaatttttgcttactttggattgtgtagatgacactttaatagttctggctgaagagcatggttgtttggacattataaaggagcttcctgaaactgtgatagatcttttgaataagtgccttaccttccatccttctaagaggttgatattatttagagattgggattacattgagatcctttacgcataagcaattggtttttttcttgttttaatataatggattaaagataatgtacatatggagtagtatataattgacatcagtatcataactgtgaatgatgtaagctttcattttttgtgaattaatgaaaaagtaattaaagttaaactacggtcagaaaactgacatacactaaagaagttactagttcattttcaagcttttaaatagaatattaactaaactatggaatgtaggtattcctagacccaataataacatcagtgaaatgagaataaaagtttgttgtcaatatgtattatagcaatgaacttggatcagtggtgtgataaactaacaattgttgacaataaaaaaggatttcttagaagtttca

SEQ ID NO: 189451 - DNA, 579 bp, Homo sapiens
  Payload ID: 17409
  Gene Symbol: TBCK
  Gene Name: TBC1 domain containing kinase
  ENST ID: ENST00000507696
  CDS Start-End: 376-579
agaaaaggccaggctgaggggagggtagagggtgaaaagctcggatctgtgtttggggaaggccaggcttgcgctcctcgccgggttccgcgaaggttaaccttggctgacttggctcgcgagcaaagggcagcgtctgagctcccggcgttccaggagtggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagaggctactactttacgcaactttggggcaccatttattttggaattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtg

SEQ ID NO: 189452 - DNA, 601 bp, Homo sapiens
  Payload ID: 17409
  Gene Symbol: TBCK
  Gene Name: TBC1 domain containing kinase
  ENST ID: ENST00000503516
  CDS Start-End: 433-601
gagacgagttcttgattttcagtttgttcagcatttttcttgttagaggaagaatgatgccttctaagctgtttatattttgtataagaaagtggaagtcctagcctttttatttttaaccattcatagccaaagctgaaataggagcagacattctgccttcaagttggaagttgaacagcagagcagcagagattgaaagatgttggtggagaagcattttacccattacttgaagatgaccagtctaatttacctcattcaaacagcaataatgagttgtctgcagctgccacgctccctttaatcatcagagagaaggatacagagtaccaactaaatagaattattctcttcgacaggctgctaaaggcttatccatataaaaaaaaccaaatctggaaagaagcaagagttgacattcctcctcttatgagaggtttaacctgggctgctcttctgggagttgagggagctattcatgccaagtacgatgcaattgataaagacactccaattcctacagatagacaaattgaagtggatattcctcgctgtcatcagtacgatgaactgttatcatcaccagaaggtcatgcaa

SEQ ID NO: 189453 - DNA, 600 bp, Homo sapiens
  Payload ID: 17409
  Gene Symbol: TBCK
  Gene Name: TBC1 domain containing kinase
  ENST ID: ENST00000509862
  CDS Start-End: 286-600
agtgtccatagcaactagtgtagttctcagtttgttcagcttctttagggaagaaccttatctttttctttttttcatggagtgtaaataactgccaatgttgtggggctggtggcagaattgacgcttctaattattcaacacttcacccttctgatttcaaaccctctgactgctgtttaacattgttcccgccttctctgagtctgaagcctctgaatctgaagggaccaaacaaacctcttgactattacagattatcttagaagacctaggactccaaaaatgtttcccctgaaggacgctgaaatgggagcctttaccttctttgcctcggctctgccacatgatgtttgtggaagcaatggacttcctctcacaccaaattccatcaaaattttagggcgctttcaaatccttaaaaccatcacccatcccagactctgccagtatgtggatatttctaggggaaagcatgaacgactagtggtcgtggctgaacattgtgaacgtagtctggaagacttgcttcgagaaaggaaacctgtgagctgttcaacggttttgtgtatagcatttgaggttcttcagggcttgcag

SEQ ID NO: 189454 - DNA, 282 bp, Homo sapiens
  Payload ID: 17409
  Gene Symbol: TBCK
  Gene Name: TBC1 domain containing kinase
  ENST ID: ENST00000505574
  CDS Start-End: 1-73
attatttcagagcttggatatttctgaaagactaaaatttttgcttactttgggccaaccccagatcaattaatgaaggacaaagtattcagtgaggtatcacctttatataccccctttaccaaacctgccagtctgttttcatcttctctgagatgtgctgatttaactctgcctgaggatatcagtcagttgtgtaaagatataaataatgattacctggcagaaagatctattgaagaagtgtattacctttggtgtttggctggaggtgacttggag

SEQ ID NO: 189455 - DNA, 2077 bp, Homo sapiens
  Payload ID: 17410
  Gene Symbol: TBC1D10A
  Gene Name: TBC1 domain family, member 10A
  Uniprot ID: Q9BXI6
  ENST ID: ENST00000215790
  CDS Start-End: 166-1692
ggggtccgcggcgcccattgggcgtggggggagagctccggggtgggcctggagccccgccccccggccttgcggcggccaataggcgccgcgcgtgggcggggcgtcggcggcagcagggcggctgaggtggccgctggagctcaggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcgctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccggggtgagctgcagtgccgctccccgcccaggctgcatggtgccaaggctatcttggatgcagaacctggtccccggcctgccctacaaccttcaccatccatccgcctgcccctagatgcccccctccctggctccaaagccaagcccaagccacccaagcaggcccagaaggagcagcggaaacagatgaaggggagagggcagctggagaagcccccagccccaaatcaagccatggtggtggccgctgcaggagatgcatgtcccccacagcatgtgcccccgaaggactcagcccccaaggactcagcccctcaggatttggctccccaggtctcagcccaccaccgctcccaggagagcttgacgtcccaagagagtgaggacacctacttgtaaccctggcagctaaggcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctggcccagccagggcaggcagaagctagggcctggggggtggggcctccttcagccccctcctcctgggggatgctccccagggttagggtgctggtgtgaggggaaagggtggggtgttctttgtgtaaaatagaaacatggttttgtacagaaataaacagccttgtatagaga

SEQ ID NO: 189456 - DNA, 578 bp, Homo sapiens
  Payload ID: 17410
  Gene Symbol: TBC1D10A
  Gene Name: TBC1 domain family, member 10A
  ENST ID: ENST00000393906
  CDS Start-End: 116-578
gtgtcctgttcctgagaacctcctctgagctgcctccgactctgtgctcctttctgagaggctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacgggg

SEQ ID NO: 189457 - DNA, 1950 bp, Homo sapiens
  Payload ID: 17410
  Gene Symbol: TBC1D10A
  Gene Name: TBC1 domain family, member 10A
  Uniprot ID: Q9BXI6
  ENST ID: ENST00000403477
  CDS Start-End: 21-1568
aggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcgccctgccctctgctccacaggctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccggggtgagctgcagtgccgctccccgcccaggctgcatggtgccaaggctatcttggatgcagaacctggtccccggcctgccctacaaccttcaccatccatccgcctgcccctagatgcccccctccctggctccaaagccaagcccaagccacccaagcaggcccagaaggagcagcggaaacagatgaaggggagagggcagctggagaagcccccagccccaaatcaagccatggtggtggccgctgcaggagatgcatgtcccccacagcatgtgcccccgaaggactcagcccccaaggactcagcccctcaggatttggctccccaggtctcagcccaccaccgctcccaggagagcttgacgtcccaagagagtgaggacacctacttgtaaccctggcagctaaggcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctggcccagccagggcaggcagaagctagggcctggggggtggggcctccttcagccccctcctcctgggggatgctccccagggttagggtgctggtgtgaggggaaagggtggggtgttctttgtgtaaaatagaaacatggttttgtacagaaataaacagccttgtatag

SEQ ID NO: 189458 - DNA, 1833 bp, Homo sapiens
  Payload ID: 17410
  Gene Symbol: TBC1D10A
  Gene Name: TBC1 domain family, member 10A
  ENST ID: ENST00000403362
  CDS Start-End: 204-1466
cccggaaggcggacgttgcagtgagccgagatcgcgccattgcactccagcctgggcaacaagcgcaaaactccgtctcaaaaaaataaaataaaaaggggagaatgatgttatagtagggttattacaaaaggtacatgtgataaaggctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggtggtggagttgcccgtgacagagcgccagattgagcgcgaacacctcattcagctgcggcgctggcaggagacccggggtgagctgcagtgccgctccccgcccaggctgcatggtgccaaggctatcttggatgcagaacctggtccccggcctgccctacaaccttcaccatccatccgcctgcccctagatgcccccctccctggctccaaagccaagcccaagccacccaagcaggcccagaaggagcagcggaaacagatgaaggggagagggcagctggagaagcccccagccccaaatcaagccatggtggtggccgctgcaggagatgcatgtcccccacagcatgtgcccccgaaggactcagcccccaaggactcagcccctcaggatttggctccccaggtctcagcccaccaccgctcccaggagagcttgacgtcccaagagagtgaggacacctacttgtaaccctggcagctaaggcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctggcccagccagggcaggcagaagctagggcctggggggtggggcctccttcagccccctcctcctgggggatgctccccagggttagggtgctggtgtgaggggaaagggtggggtgttctttgtgtaaaatagaaacatggttttgtacagaaata

SEQ ID NO: 189459 - DNA, 861 bp, Homo sapiens
  Payload ID: 17410
  Gene Symbol: TBC1D10A
  Gene Name: TBC1 domain family, member 10A
  ENST ID: ENST00000437122
  CDS Start-End: 67-354
cggggcgtcggcggcagcagggcggctgaggtggccgctggagctcaggcggcgggcgcggctgggatggcgaagagcaacggagagaatgggccgcgcgcgcccgcggccggggaaagcctgtcgggaacccgggagagcctggcccagggccccgacgccgcaaccaccgacgaactcagctctctcgggtctgactcggaggccaacggcttcgccgagcgccgcatcgacaagttcggcttcatcgtgggctcgcagggcgccgagggcgcattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaag

SEQ ID NO: 189460 - DNA, 2021 bp, Homo sapiens
  Payload ID: 17410
  Gene Symbol: TBC1D10A
  Gene Name: TBC1 domain family, member 10A
  ENST ID: ENST00000433426
  CDS Start-End: 170-1060
ggcatggaagacggcataaagaggagctggattgcaggcagtgagacctgttgggagaatcaaggatggcctaaaagggctgtggtgagacctggaagaggtctggagcagtgaggataaagaggctggcaaatcattagtgcttggttcatgactgccatgtgggctgatggagaggctggaggaagtacccctggaggtgctgaggcagagggagtccaagtggctggacatgctcaacaactgggacaaatggatggccaagaagcacaaaaagattcgtctgcggtgccaaaagggcatcccgccttctctgcggggccgtgcttggcagtacctgtcaggaggcaaggtgaagttacagcagaaccctggaaagtttgacgagctggacatgtcccctggggaccccaagtggctggacgtgattgagcgtgacctgcaccggcagttcccattccatgagatgtttgtgtcccgggggggccacggccagcaggacctattccgtgtgctgaaggcctacacgctgtaccggcccgaggagggctactgccaggcccaggcgcccattgccgctgtcttgctcatgcatatgcctgctgagcaagccttctggtgcctggtacagatctgtgagaagtacctgcccggctactacagcgagaaactggaggcgatccagctggacggggagatccttttctcgctgttgcagaaggtgtcgccggtggcccacaagcacctcagccgtcagaagatcgacccgctcctctatatgacagaatggttcatgtgcgccttctcccgaaccttgccctggagctctgtgctgcgtgtctgggacatgttcttctgtgaaggggtcaagatcatcttccgggtggggctggtgctgctgaagcacgcgctgggctcccctgagaaggtcaaagcctgccagggccagtacgagaccatcgagcgactgcggagcctcagccccaagatcatgcaggaggcctttctggtccaggaggggcaattaggtggaacatgcgtgaccagcttttacacatgaggaaatggaggctcacagaggcagaatcactaagcaactccccttaaagtcacccacccaggtggagctggaatttgagcctaagcagccaggctgccctgggcagcggtgggtgacaggtggtggagttgcccgtgacagagcgccagattgagcgcgaacacctcattcagctgcggcgctggcaggagacccggggtgagctgcagtgccgctccccgcccaggctgcatggtgccaaggctatcttggatgcagaacctggtccccggcctgccctacaaccttcaccatccatccgcctgcccctagatgcccccctccctggctccaaagccaagcccaagccacccaagcaggcccagaaggagcagcggaaacagatgaaggggagagggcagctggagaagcccccagccccaaatcaagccatggtggtggccgctgcaggagatgcatgtcccccacagcatgtgcccccgaaggactcagcccccaaggactcagcccctcaggatttggctccccaggtctcagcccaccaccgctcccaggagagcttgacgtcccaagagagtgaggacacctacttgtaaccctggcagctaaggcctccagggcggggtctccatataactacacggttcatgaactgacattccacatcctgcccaccctctgagggccaagctgcctggccactgggctgggctggagtctggctggtccaacacagattctgcctggtccaacacagattctgcctgagcctccttatttattttctttacagtggcactcaggctggcccagccagggcaggcagaagctagggcctggggggtggggcctccttcagccccctcctcctgggggatgctccccagggttagggtgctggtgtgaggggaaagggtggggtgttctttgtgtaaaatagaaacatggttttgtacagaaa

SEQ ID NO: 189461 - DNA, 3350 bp, Homo sapiens
  Payload ID: 17411
  Gene Symbol: TBC1D10B
  Gene Name: TBC1 domain family, member 10B
  Uniprot ID: Q4KMP7
  ENST ID: ENST00000409939
  CDS Start-End: 82-2508
ggctggcctcgccgggaggcccgaggggcggcgccttctgcggcctccccggcggggggatgtgaggggcggcccgcggccatggagacgggcacggcgcccctggtggccccgccgcgccgtcatggcgcccccgcggccccctcgccgccgccccggggttcccgggccgggcccgtcgtggtggtggctccgggacctccagtgactacggccacttcggcccccgtcaccctggtggcccccggggaggcgcggcccgcctgggtcccggggtcggccgagacctctgctccggccccggccccagccccggccccagccccggctgtcacgggcagcacggtggtggtgctgaccctggaggcctcgcccgaagccccaaagccgcagctcccctccggcccggaatccccagagcccgcggcagtggctggagttgagacatcgagggctctggccgcaggggcagactcgccgaagacagaggaggctcgaccctcacccgccccaggaccagggacccccaccgggacccctaccaggaccccttccagaacggctcctggtgccctgaccgccaaacccccgcttgcccccaagccgggaaccacagtggcctcaggagtgactgcacggagtgcatcaggacaagtgacaggtgggcatggagctgccgcagcaacatcagcatcagcaggacaggctcctgaggacccctcaggccctggcacaggcccctctgggacttgtgaggctccggtagctgtcgtgaccgtgaccccagctccggagcctgctgaaaactctcaagacctgggctccacgtccagcctgggacctggcatctctgggcctcgagggcaggccccggacacgctgagttacttggactccgtgagcctcatgtctgggaccttggagtccttggcggatgatgtgagctccatgggctcagattcagagataaacgggctggccctgcgcaagacggacaagtatggcttccttgggggcagccagtactcgggcagcctagagagctccattcccgtggacgtggctcggcagcgggagctcaaatggctggacatgttcagtaactgggataagtggctgtcacggcgattccagaaggtgaagctgcgctgccggaaggggatcccctcctctctcagagccaaagcctggcagtacctgtctaatagcaaggaacttctggagcagaacccaggaaagtttgaggagctggaacgggctcctggggaccccaagtggctggatgtgattgagaaggacctgcaccgccagttccctttccacgagatgtttgctgctcgaggggggcatgggcaacaggacctgtaccgaatcctgaaggcctacaccatctaccggcctgacgagggttactgccaggcccaggcccccgtggctgcggtcctgctcatgcacatgcctgcggagcaagccttttggtgcctggtgcagatctgcgacaagtacctcccaggttactacagtgcagggctggaggccattcagctggacggggagatcttttttgcactcctgcgccgggcctccccgctggcgcatcgccacctgcggcggcagcgcattgaccctgtgctctacatgacggagtggttcatgtgcatcttcgcccgcaccctgccctgggcgtcggtgctgcgtgtctgggacatgtttttctgtgaaggcgttaagatcatcttccgggtggccctggtcctgctgcgccacacgctgggctcagtggagaagctgcgctcctgccaaggcatgtatgagaccatggagcagctgcgtaacctgccccagcagtgcatgcaggaagacttcctggtgcatgaggtgaccaatctgccggtgacagaagcactgattgagcgggagaatgcagcccagctcaagaagtggcgggaaacgcggggggagctgcagtatcggccctcacggcgactgcatgggtcccgggccatccacgaggagcgccggcggcaacagccacccctgggcccctcctccagcctcctcagcctccctggcctcaagagccgaggctcccgggcagctggaggggccccgtccccgccgccccccgtccgcagagccagtgctgggcctgccccagggcctgtggtcactgctgagggactgcatccatcccttccctcacccactggcaatagcacccccttgggttccagcaaggagacccggaagcaggagaaggagcggcagaaacaggagaaggagcggcagaaacaggagaaggagcgggagaaggagcggcagaagcaggagaaagagcgagagaagcaggaaaaggagcgagagaagcaggagaaggagcggcagaagcaggagaagaaggctcaaggccggaagctttcgctgcgtcgaaaggcagatgggcccccaggcccccatgatggtggggacaggccctcagccgaggcccggcaggacgcttacttctgacctctgccctggggctggactgcatggcccccctctttccctcagccaagaacaggcctggcccaaggtgccaccccctagcaccttgtcaggctgtcccttgctggggaaagtggcttggttccccatctcctcgccagctgctgatccctacacgggcaggacagatgggcagctgcaaatgagtctggagcctctcatctcccatgaggctcagctggggtctctgtcgctcctgccccagttccctctgggtcccctcctaggtgctgtcctgaatggcccgttgtcatcccaggggtgactcctggtgatgggagtcagcagtttcagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttccataatgctcctgtacccagtttatttaaggggacatgcactggaataggaaatgtcccccatctcccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgg

SEQ ID NO: 189462 - DNA, 1031 bp, Homo sapiens
  Payload ID: 17411
  Gene Symbol: TBC1D10B
  Gene Name: TBC1 domain family, member 10B
  ENST ID: ENST00000490703
  CDS Start-End: 1-555
gtgaagctgcgctgccggaaggggatcccctcctctctcagagccaaagcctggcagtacctgtctaatagcaaggaacttctggagcagaacccaggaaagtttgaggagctggaacgggctcctggggaccccaagtggctggatgtgattgagaaggacctgcaccgccagttccctttccacgagatgtttgctgctcgaggggggcatgggcaacaggacctgtaccgaatcctgaaggcctacaccatctaccggcctgacgagggttactgccaggcccaggcccccgtggctgcggtcctgctcatgcacatgcctgcggagcaagccttttggtgcctggtgcagatctgcgacaagtacctcccaggttactacagtgcagggctggcgttaagatcatcttccgggtggccctggtcctgctgcgccacacgctgggctcagtggagaagctgcgctcctgccaaggcatgtatgagaccatggagcagctgcgtaacctgccccagcagtgcatgcaggaagacttcctggtgcatgaggtgaccaatctgccggtgacagaagcactgattgagcgggagaatgcagcccagctcaagaagtggcgggaaacgcggggggagctgcagtatcggccctcacggcgactgcatgggtcccgggccatccacgaggagcgccggcggcaacagccacccctgggcccctcctccagcctcctcagcctccctggcctcaagagccgaggctcccgggcagctggaggggccccgtccccgccgccccccgtccgcagagccagtgctgggcctgccccagggcctgtggtcactgctgagggactgcatccatcccttccctcacccactggcaatagcacccccttgggttccagcaaggagacccggaagcaggagaaggagcggcagaaacaggagaaggagcggcagaaacaggagaaggagcgggagaaggagcggcagaagcaggagaaagagcgagagaagcaggaaaaggag

SEQ ID NO: 189463 - DNA, 1497 bp, Homo sapiens
  Payload ID: 17412
  Gene Symbol: TBC1D10C
  Gene Name: TBC1 domain family, member 10C
  Uniprot ID: Q8IV04
  ENST ID: ENST00000312390
  CDS Start-End: 17-949
gaaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacggcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccggcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacag

SEQ ID NO: 189464 - DNA, 1520 bp, Homo sapiens
  Payload ID: 17412
  Gene Symbol: TBC1D10C
  Gene Name: TBC1 domain family, member 10C
  Uniprot ID: Q8IV04
  ENST ID: ENST00000526387
  CDS Start-End: 39-971
ggaggaggaggaagtgagaggaggaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacggcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccggcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacaga

SEQ ID NO: 189465 - DNA, 1796 bp, Homo sapiens
  Payload ID: 17412
  Gene Symbol: TBC1D10C
  Gene Name: TBC1 domain family, member 10C
  ENST ID: ENST00000529635
  CDS Start-End: 75-734
ggctggccgggagtggcccctcacactggttctccccactttctctgcctgtggcatcgaaggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggtgagaggctgacatgggggctggaggaaggaggggcaggggcccggaggctgtgcggctggacgccgaggtgttcatggccctgctgcggcggctgcttccgcacgtgcacaagcacctgcagcaggtgggcgtcggacccctgctgtacctgcccgagtggttcctgtgcctcttcgcccgctccctgcccttccccacagtgctgcgtgtctgggatgccttcctcagtgagggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccggcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccagagggcaccaggaataaaatcttcttgaacaga

SEQ ID NO: 189466 - DNA, 1659 bp, Homo sapiens
  Payload ID: 17412
  Gene Symbol: TBC1D10C
  Gene Name: TBC1 domain family, member 10C
  Uniprot ID: Q8IV04
  ENST ID: ENST00000542590
  CDS Start-End: 15-1355
aggccccgggcaccatggcccaggccctgggggaggacctggtgcagcctcccgagctgcaggatgactccagctccttggggtccgactcagagctcagcgggcctggcccatatcgccaggccgaccgctatggattcattgggggcagctcagcagagccagggccgggccacccacctgcagacctcatccgccaacgggagatgaagtgggtggagatgacctcgcactgggagaaaaccatgtcccggcggtacaagaaggtaaagatgcagtgccggaaaggcatcccgtctgccctgcgcgcccgatgctggcccctgttgtgtggggcccatgtgtgccagaagaacagccctggcacctatcaggagctggcagaggcccctggagacccacagtggatggagaccattggcagggacctgcaccgtcaattccctctgcacgagatgtttgtgtcgcctcagggccacgggcagcaggggctcctgcaggtgctcaaggcctacaccctgtatcgaccggagcagggctactgccaggcccaggggcccgtggctgctgtgctgctcatgcacctgcccccagaggaggccttctggtgcctggtgcagatctgtgaggtctacctccctgggtactacgggccccacatggaggctgtgcggctggacgccgaggtgttcatggccctgctgcggcggctgcttccgcacgtgcacaagcacctgcagcaggtgggcgtcggacccctgctgtacctgcccgagtggttcctgtgcctcttcgcccgctccctgcccttccccacagtgctgcgtgtctgggatgccttcctcagtgagggtgccagagtactgttccgtgtggggctgacactggtgcgcctggcgctgggcactgcagagcagcgaggggcctgccctggcctcctggagacactgggagcccttcgagccatcccccccgcgcagctgcaggaggaggccttcatgtcacaggtgcacagcgtggtgctgtcagagcgggacctgcagcgggagatcaaggcccagctggcccagctgcccgattccgcgccgggacccccgccccggccacaggtccgcctcgccggggcccaagccatctttgaggcccagcagctggcaggagtgcgacgaggcgccaagcctgaggtgcctcggattgtggtgcagcccccggaggagcccagaccaccgcggcggaaaccccagacccgcggcaagactttccatgggctcctgactcgggcccggggcccccccatcgaggggccccccaggccccaacgaggctccacctccttcctggacacccgcttctgagaggaccatggacttagtgtcccccagtctcaattgcctgatggctgatgccggcccggcaaataggcaccgcactttactcttgggactcggggacttggcttccttcctggcaaggaccaggcagtggggaaggaggaggtcctccgtggtacatactgggtcaggcactagcatggaggagggtcacagagtggggcacgtgaggacccatggaaccgtcctggtgcccaggccctcacaagtaccaaagccagcaccaaaggagtcagggaaggggttggctgagtcaagggaccccaga

SEQ ID NO: 189467 - DNA, 5272 bp, Homo sapiens
  Payload ID: 17413
  Gene Symbol: TBC1D12
  Gene Name: TBC1 domain family, member 12
  Uniprot ID: O60347
  ENST ID: ENST00000225235
  CDS Start-End: 111-2438
gaacgttgcggcggctgtcgccgcggccccagcacccagagctgttctctggccaagcctgcgcctgtagtccttctttgcctcctggggcggccgccacccacccccagatggtgggtccggaggatgccggagcctgctcgggaagaaaccccaagttgctcccggtgcctgcgccggaccccgtgggccaggacaggaaggtaatccgggccacgggcggctttggcggaggcgtcggcgctgtggagccgccggaggaggctgacgaggaggaggaggctgacgaggaggaggagacgccgcctcggcagctccttcagcgttacctcgcggcggccggggagcagctggagccggggctctgctactgtccgctccccgctggccaggccggcgccccgccgccctcggcagccccacgatcggacgcctgcctgctgggctcgggctccaaacaccgcggcgcggaggtggctgatggccgcgcgccgcggcacgaaggcatgaccaacggcgactcgggttttctgccgggccgggactgtcgcgatctggaagaggctcgcgggctggcgcgcgccggcggccgggagtcgcgccgccgccgcccctacggccgccttcgcctggaggggcctggcgacgaggacgcggacggcgcgggaagcccgtccgattgggcctctccgcttgaggacccgctgcggagctgctgcctggtggccgcggacgcccaggagcccgagggcgcgggcagcgactcgggggacagccccgccagcagctgcagcagtagcgaggactcagagcagcggggagtcggcgccgggggtcccgaggagggcgcgccccctgccacctcggccgagaggactaatgggggtgcggagccgcgcctgggcttttctgacattcacttcaactctcgcaacacgttccaggtgagccgcggtcagagcgcccgcgatcacctgcccccggcggggccgccggtgcccttgcccgccgcggagcagggtcctgcgggggcttcggcccgggctcgacggagtggcggcttcgcggacttcttcaccagaaacctttttccaaaaaggacaaaggaactcaaatcagttgtccatagtgctcctggttggaaattatttggtaaagtccctcctagagagaatcttcagaaaacatccaaaatcattcagcaggaatatgaagcacgaacggggaggacctgtaaaccaccacctcagtcttcaagacgcaagaattttgaatttgagccgctttctaccactgccttgattcttgaggatcgaccatcaaatcttcctgccaaatctgtggaagaagctttacgtcaccgacaagaatacgatgagatggtggctgaggctaaaaaacgagaaattaaggaagcacataaaagaaaaagaatcatgaaagaacgatttaagcaggaagaaaatattgcaagtgcaatggtaatttggatcaatgaaatactgcccaattgggaagtaatgcgtagtacaagaagagttcgagaattgtggtggcagggattgccccctagtgtccgtgggaaagtttggagtctagctgtaggaaatgaactaaatatcactcctgaactttatgaaatcttcctctcaagagcaaaagaacggtggaaaagtttcagtgaaacaagttcagagaatgatacagaaggtgtatctgttgctgatcgagaggccagtctggaattaattaagttggacatatcccgtacatttccatctctctacatctttcagaagggtggtccatatcatgatgtcttgcatagtattttaggggcatacacatgctacaggcctgatgttggttatgtccaagggatgtccttcattgcagcagtactcattctcaatttggaagaggcagatgcctttatcgcatttgccaatctcctgaataagccatgccagttggccttttttcgtgtggatcacagcatgatgttgaaatattttgcaacatttgaagtattctttgaagaaaatctttccaaattatttcttcacttcaaatcttacagtcttacaccagatatatacttgatagactggatcttcacactatatagcaaatcactaccacttgatctggcctgtcgagtctgggatgtattttgcagagatggggaagaatttttatttaggactggattaggaatcctccgattatatgaagatattctcctgcagatggactttattcatatagcacagtttctaactaaattgccagaagatatcacatcggaaaagctgttcagttgtattgcagccattcagatgcagaatagcaccaaaaaatggactcaggtctttgcatctgtaatgaaggatattaaagaaggagacaagaacagtagtcctgctttgaaaagctagtcttcaaaattgacagactaactgacatagaaaaagtggtttttggataaaggttttttgtttcctatgtaaaaggcgtggaagaaaatgttggagatacctaaaagaatcaagaggtggaaaactgctgattttacattttatggctgaagtaaatgaaataagtaacttattgacagtattaataaactattattttgtaggtagagtcatttttcaaaggaaaaagtttaagtggtgagtttatattccacaatttggagtaaacaaaatgcaataaatttttaaaatagctttgaagatacttcaaatttttacatcttttcttttgtaacagttaccacaaagatattctggaggctagagtaggattgttaaatactactgttaacctccaaagtactatagtacagacattgtttccagttctgaccttttgaagatattatagaccagtaatgaacagatttggttgtaaattatttaagtcactgaagatgtcatttatcttcattcacaagttggggcaaattcgagttacctaggaactggaaatgttggtgggagattgtttattgtttgtttagatgtttttccatagtatggtgtccatttgttttttaagggaaattttttgtcttccttaaggaattcctatcactcagagaattttagccattctggttctagtctaacaaattattcatctaataatttgacattaagaaaactataaataactggtagaaggaaagtgctttgcacttcagtggattgaagacttgactttgagagtaagtccaaaaacatatatgatgtttctcagtgataagagtaaaaagtaatgaatcctgagagttcttaaacagcatgctacttggcaagacttcatattttttagttacaattcttccactgtttaactccagtttgaaatttgaaatctaatatgtagctaaatctgtgacttgtaaaactctatgcataatttttcctaatcagtggaaataagaataaaagaaaaaggtaaagttaattttttttctaagtctacatcctatctcttgattcagttgcctgaagaagctgggtaaggagattagtcttgttattgattcttttatgtgtcagtgccatcttaatctcttcacatggtacactaaatgctgcctataacccatcctcatcttctttactcatcattgctttcttcaaggaaggtcttgatactgccctcgtctacctcactatccgctagtctagatagtgactctttggaaaattggtagcctctgaatgagttatccaacttctgcttcctcacattggccactttgcataggttcgggaacttagcaggttttaaatcatcatgcccatggaggtgaaatactttgaggaatgggaacatctcttcactgtgtttttggatcagccttctctcaaccgccaagaaatgcatgatttccctgccaactctaggaagtagtgctgcatgattgaatcattatttgatgaattctttcattgtaacatagggagtcattttcaaaaaggtagatatgaacttaaattaaattgacttatgaatgctttgcctgtgggcccaacagtgtcatgaccctccaattgaaacatagcatgaattatttttatgtcgagttcttgaactgctaatcaggtgtgtgtttccttgaagtccagagcaggatccaggtcagatgaaggaggtggtatgcctggcttaactgctgaaaatagagcattgaaactcttcacaatgtgctgcattgggtttctgcttggctttctcactgaaaagtaaattggggaaaatgctgcttttactattttgcattttatagcaacattaacagtcttttcccagtcaggtgctgtccagggaacatgtttcccttgggaggtctgaacagagtgacctggcttgatgtatttcctgagctctagtaccatatcatagaattagttaaatgtagtcaacagcaatgtcagaacaattgacattgtctttccaagagtgaatgcattggctttcggaactgctactagagacatacatgaggcagcgaacacatctttaggtgggggcaaggctatatctgattgacagagatctctgatctctaatgacatattgctattgtcctattatgtttaaatttgaacctaaatcacttgagtgttatgagtgatggctatataacatgctgtttggttagatttacagtgtgtttttatgttgcagtttagtttgaaacaacacttaagcacactatttctgttagtgtatatagttttcaaactaacaagcctgcgatccttgttagtgtagtgactgcctctttaggagtatggggccctagggtgtccatatatttttaccccatgggtcattctagtctaaggactactagtagaaccctcaaaaggtaattgctattatagggacttacttattggagactggtaatataataaaatattgaaggagtggccatggtcttagcaggttttagaatgaccttttaactccagtaactacttccttggtattggtatccttgatagagggaatataacatctggcagtaatctcattcaggttatactacctgactaaatttaatcatactttcatgtatttgtttcctcagttggacctaagttactgtatttgtttttcttatttttttattattgtacagtttctttacctttcaagtataaatgtgtatataaaatgtaaatacaaagaattcactaaaaaccactcataacaattactgtgtaaataaaactggtaagcagagtaa

SEQ ID NO: 189468 - DNA, 3378 bp, Homo sapiens
  Payload ID: 17414
  Gene Symbol: TBC1D13
  Gene Name: TBC1 domain family, member 13
  Uniprot ID: Q9NVG8
  ENST ID: ENST00000223865
  CDS Start-End: 6-833
acaccatgtcaagtctgcacaagagccgaattgcagatttccaggatgtcctgaaggagccctcaattgcattggaaaagctgcgggaactcagctttagtggcatcccctgtgagggcggactgcggtgcctctgctggaagattctcttgaactaccttcccttggagagagcctcatggacctccatcctggccaagcagagggagctgtatgcccagttcctgagggaaatgatcatccagcctggcattgccaaggccaacatgggtgtgtccagggaggatgtgacttttgaggaccatccactcaaccccaaccctgacagccggtggaacacgtacttcaaggacaacgaggtgctgctgcagatcgacaaagatgtccggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtagcccggcggcaagaggcccatgttccggagagaagcctcccgaccctgtgccctggctcccgggacacatagaaacctgtaggaacccagcctgaggggaagccacaggatcggcccgagacccaggccatgcccactggggacacactgtgccgtgctccttctgccgccacgcccagctccccacctgccctgcactctgccctctttgcccaggatactgaggagggctggagctcgggaagttgtccttcctgggccagggccgtttctggcactgggaggctggcaggggcccctccctgcctcggctctgccgccccagcctcagttcctgcttctggtcttctcctgggctccactcaggggaggtgcttggccaatgggccagaaaccgcttctgagcggggcacttcggctgctccacagggaaggcgacactgaaagctgagtcctgccgtctgtctcacccacagatgtctgtagtcggtcggtgtgaatgtgggcccaagtccccaggcatcttctccgtgtgtgtgtgtgtgtgtgtgtgtgtgtgtgtgtgtgtgtgtgtgtgttagggagtgagggtctctcaggcctccaggtctcccagcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccaggaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcgagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgc

SEQ ID NO: 189469 - DNA, 3906 bp, Homo sapiens
  Payload ID: 17414
  Gene Symbol: TBC1D13
  Gene Name: TBC1 domain family, member 13
  Uniprot ID: Q9NVG8
  ENST ID: ENST00000372648
  CDS Start-End: 151-1353
ggcggtggaacgcgcaggctagtggctgtgtttcccgccggaggcttttgcgcagagccccgcgtccctggggggcggcggcggcggcggcagcgcaggcggcagaggcgcaggcggcggaggcggctggggggtccggaagtcaacaccatgtcaagtctgcacaagagccgaattgcagatttccaggatgtcctgaaggagccctcaattgcattggaaaagctgcgggaactcagctttagtggcatcccctgtgagggcggactgcggtgcctctgctggaagattctcttgaactaccttcccttggagagagcctcatggacctccatcctggccaagcagagggagctgtatgcccagttcctgagggaaatgatcatccagcctggcattgccaaggccaacatgggtgtgtccagggaggatgtgacttttgaggaccatccactcaaccccaaccctgacagccggtggaacacgtacttcaaggacaacgaggtgctgctgcagatcgacaaagatgtccggaggttgtgcccagacatttccttcttccagagggccactgactacccttgcctcctcatcctggacccccagaatgagtttgaaacccttcgtaagagagtggaacagacaacactgaaatctcagacggtggcccggaaccggagtggggtcacaaatatgagctccccacacaagaactctgtgccatcatccctaaatgagtatgaggtgctgcccaatggctgtgaggcccactgggaggtggtggagcggatcctgttcatctacgccaagctcaaccctggcatcgcttatgtgcaaggcatgaatgaaatcgtggggcccctctactacacctttgccaccgaccccaatagtgagtggaaagagcacgccgaggcagacacctttttctgcttcaccaacctcatggccgagatccgggacaactttatcaagagcctggatgactcgcagtgtggcatcacctacaagatggagaaggtttactccaccttgaaagataaggatgtggagctctacctgaaactgcaagagcagaacatcaagcctcagttctttgccttccgctggctgacactgctgctgtcccaggagttcttgctgcctgacgtcatccgcatctgggactccctcttcgccgatgacaaccgctttgacttcctcctcctcgtctgctgcgccatgctcatgctgatccgggagcagttgctggaaggggacttcactgtgaatatgcggctgctgcaggactaccccatcacagatgtctgccagatcctgcagaaagccaaggagctccaagactcaaagtagcccggcggcaagaggcccatgttccggagagaagcctcccgaccctgtgccctggctcccgggacacatagaaacctgtaggaacccagcctgaggggaagccacaggatcggcccgagacccaggccatgcccactggggacacactgtgccgtgctccttctgccgccacgcccagctccccacctgccctgcactctgccctctttgcccaggatactgaggagggctggagctcgggaagttgtccttcctgggccagggccgtttctggcactgggaggctggcaggggcccctccctgcctcggctctgccgccccagcctcagttcctgcttctggtcttctcctgggctccactcaggggaggtgcttggccaatgggccagaaaccgcttctgagcggggcacttcggctgctccacagggaaggcgacactgaaagctgagtcctgccgtctgtctcacccacagatgtctgtagtcggtcggtgtgaatgtgggcccaagtccccaggcatcttctccgtgtgtgtgtgtgtgtgtgtgtgtgtgtgtgtgtgtgtgtgtgtgtgttagggagtgagggtctctcaggcctccaggtctcccagcccctccttctctgtctctacctctctgcctgtctccttccacctccttcccagagtgggactgtgtcttgcttcatgattcctctctccattactctccctgcccttctctgttggggtgccttatcctgagccacctcctctccccgcttgcctctgctcccctgaacctgggagacagatgaggagactggctcagcaaggcccctggaggtcaagcttggcctttgcctcctgttcccatcccccagccctggctcctaggtcctcccaactgggagggagtcctccgtgcctcacttagagggttctgaacccgttccctacacagaaatcttggaaaccaaatgctgctgagtaaggatgaagctttgagcctcctgcccctgctttctgcccagggagggagaaggaagagggggagctggtttttctggaggttcccccagaggccctcctgtccgaaaagaaaaggaccttgattctgagcccagggtcggaacccattgcttcagaagagttgtcattccctcggcttccaggtcccaacccagggttgggttgagtgagtcccacaaagggcaagtggggcccgaggaagcctctctggggccaggggtagctgagcttaaaggccctgggtcctgccagttccaggagggccatgtctgtgcctctgtgtacccctccacccgctgcgggctgagggaggtgcagggccttctctgacccctgcctgagctgttcccagggctggagcaggtgtaccctgagcaggggcagctggccactcccagttctcaccaagtcacctccctccttgtacaaggtttgcgtccggaagccgggtgccatagtgaggaccctcgtcctccagactggctggcaggagtcaggccccagcagccctcctgcccccaaagctttccgagtctggtgggcaggacttctcgctgcccttccaagcccggctttgggccaggaaaggcttccccaggtggctcttctaccaggcttttcctttgatgccgcctggatttccgcacctgcctgtctcctctcccagagcacagtatttgggagactttgactatttattcagactcctggctatgtattgcacattggcaagtgctctggggatgaggcatgggtataggaagggagaaaggagttggagacaagatcctcttcattttccaagatcaaagtcagcctcttctccccatgcttctaggaactgcctggttttcgagcaggtcctggctgagcgggctctgagttctgtactggaattgagtgtaaagatgggaagagaactgggctgactccaggacctccaggatgaggcagaggcatgatgcttcctgctcacctgggccaccctctctccaggacttgtcagctggtggttcagccccttctccaaccccttcataagcttgggccactgcctgggacccagcagacactgcccaggactctttagtgcactcactcttgtctgccccctaccttccctcctggaaccacactacttgaatcaccattactttgcctcgctggcagagttgggtcaagtgccctctccttgaccttgagatgaaggtcaagagcacagggaccaggccttggttaggctgagctcccagcaggacaccgcctgcagaaaggacctgccctgataatgtcccttccccagattctcaagcagatgcccaagggaggtccccacagagccagagtgcctgaggcttcctgcttgagaacctgccccctggatcttggacacttacagattgagctgtatgaattcagcgggtctcactccagagggtcagaacgtttgctttagttttttcatctgttttgttccttgagtcagtgctgttgatgacgagttgtcttgaataaatcatgtgttctttgcaatgggca

SEQ ID NO: 189470 - DNA, 4201 bp, Homo sapiens
  Payload ID: 17415
  Gene Symbol: TBC1D14
  Gene Name: TBC1 domain family, member 14
  ENST ID: ENST00000410031
  CDS Start-End: 82-1479
ctctggcgtgccaggaatgcggcacggggagagtccgtgcttctgcagccggcccctcggagctgcgaggtcacagtagacatgatggccatctcccctgcgctcctgttcatggacaggaacttgcttgctagaaaacaaagtgcaaggcttgacaaacacaatgacttgggatggaagttatttgggaaagcgccactccgagagaatgcccagaaggattcaaagagaatacagaaggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggcagccgagaagaacagacgctctttaagtttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttttccagagctggaggtcacgtttctaaaactcacctacgaaagatagcattaaaggaacaggggctctctgaggatggccactgatgtgtgtttgtggatacctgggcatcgacccagcctgcaggtgagctctgggccatgttgccttgacacagtcacagtgtagaggctgcaggtgcacacgtgggctccagtgggactgcgctctgggagactgctccctggcatcggtcctgcggaggtggaaagttcgagaggaggagctatttgcgaggaagccctgtggcaatagagataggcttaaaagcggagagaacacagagtggaatcagccccctgtaagtaaaagggtagagaaagagatgtgtggctgggccctctcccacctgcctgttcagtggaggccagggcagcagcccagaacagcacatgtgggggaggtggccccttgtgccagcagtggctcctctctgcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgtta

SEQ ID NO: 189471 - DNA, 4925 bp, Homo sapiens
  Payload ID: 17415
  Gene Symbol: TBC1D14
  Gene Name: TBC1 domain family, member 14
  Uniprot ID: Q9P2M4
  ENST ID: ENST00000409757
  CDS Start-End: 125-2206
tgcctaccgcgtgcccggcgtcctcgtcgcgcgagttgccggtcccgcggggcctgggctgcgggcccacgggtcccggggatggcgtcggagccgcgctaactccgtttctccttggaccaagatgactgatggaaaactctccacctctacaaatggcgtagccttcatgggtattctggatggtcgaccaggaaacccccttcagaacctgcaacacgtcaatctcaaggcgccccgactcctctccgcgcctgagtacgggcccaagctgaaactcagggctttagaagaccggcacagcctccagtccgtggactcggggattcctaccctggagatcgggaacccggagcctgtaccctgcagcgcggtccacgtgaggaggaagcagtccgactccgacctcatccccgagcgggccttccagagcgcctgcgcgctgccatcctgtgcgccaccagctcctagcagcaccgagcgggaacagagcgtgcgcaaatcctccacgtttcccaggacaggctatgactcggtaaagctctatagcccgacctccaaagccctgacccgcagcgatgatgtctccgtctgcagcgtgtccagtcttgggacagagctgtccaccacgctgtccgtcagcaatgaggacatcttggaccttgtggtcacgagcagctccagtgccattgtgaccctggagaatgacgatgacccacagtttaccaacgtcaccttgagctctatcaaggaaacccgtggcttacaccagcaggactgtgttcatgaagctgaggaggggagtaaattgaaaatattggggccatttagtaacttctttgcaaggaacttgcttgctagaaaacaaagtgcaaggcttgacaaacacaatgacttgggatggaagttatttgggaaagcgccactccgagagaatgcccagaaggattcaaagagaatacagaaggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggcagccgagaagaacagacgctctttaagtttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttttccagagctggaggtcacgtttctaaaactcacctacgaaagatagcattaaaggaacaggggctctctgaggatggccactgatgtgtgtttgtggatacctgggcatcgacccagcctgcaggtgagctctgggccatgttgccttgacacagtcacagtgtagaggctgcaggtgcacacgtgggctccagtgggactgcgctctgggagactgctccctggcatcggtcctgcggaggtggaaagttcgagaggaggagctatttgcgaggaagccctgtggcaatagagataggcttaaaagcggagagaacacagagtggaatcagccccctgtaagtaaaagggtagagaaagagatgtgtggctgggccctctcccacctgcctgttcagtggaggccagggcagcagcccagaacagcacatgtgggggaggtggccccttgtgccagcagtggctcctctctgcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattg

SEQ ID NO: 189472 - DNA, 4149 bp, Homo sapiens
  Payload ID: 17415
  Gene Symbol: TBC1D14
  Gene Name: TBC1 domain family, member 14
  Uniprot ID: Q9P2M4
  ENST ID: ENST00000451522
  CDS Start-End: 186-1427
cagcgcggatcgcctcgctgtgtctgcgcgcgattgagcggcctgccgccccgccccgccccgcgagtctgaggagccgccgcgtccgcccgcccgcccgcggtccgggagggagggagggaggccggccctccgctcgctgggcatggagcctccggccgcgcgcctctaaggccccggcgttcatggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggcagccgagaagaacagacgctctttaagtttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttttccagagctggaggtcacgtttctaaaactcacctacgaaagatagcattaaaggaacaggggctctctgaggatggccactgatgtgtgtttgtggatacctgggcatcgacccagcctgcaggtgagctctgggccatgttgccttgacacagtcacagtgtagaggctgcaggtgcacacgtgggctccagtgggactgcgctctgggagactgctccctggcatcggtcctgcggaggtggaaagttcgagaggaggagctatttgcgaggaagccctgtggcaatagagataggcttaaaagcggagagaacacagagtggaatcagccccctgtaagtaaaagggtagagaaagagatgtgtggctgggccctctcccacctgcctgttcagtggaggccagggcagcagcccagaacagcacatgtgggggaggtggccccttgtgccagcagtggctcctctctgcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgtta

SEQ ID NO: 189473 - DNA, 602 bp, Homo sapiens
  Payload ID: 17415
  Gene Symbol: TBC1D14
  Gene Name: TBC1 domain family, member 14
  ENST ID: ENST00000439515
  CDS Start-End: 1-602
ttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaagttctcatctttgtggatttccgtgtgggtcttcagaaatcttttcagaagaggaaagagagggaatctacaaagctccagcagctttggtcctggtgtctgggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatgg

SEQ ID NO: 189474 - DNA, 4887 bp, Homo sapiens
  Payload ID: 17415
  Gene Symbol: TBC1D14
  Gene Name: TBC1 domain family, member 14
  Uniprot ID: Q9P2M4
  ENST ID: ENST00000448507
  CDS Start-End: 80-2161
gagccccttccccctcccggccgcttcccacttccaagatggctgcgggtggagccgaccagtttctccttggaccaagatgactgatggaaaactctccacctctacaaatggcgtagccttcatgggtattctggatggtcgaccaggaaacccccttcagaacctgcaacacgtcaatctcaaggcgccccgactcctctccgcgcctgagtacgggcccaagctgaaactcagggctttagaagaccggcacagcctccagtccgtggactcggggattcctaccctggagatcgggaacccggagcctgtaccctgcagcgcggtccacgtgaggaggaagcagtccgactccgacctcatccccgagcgggccttccagagcgcctgcgcgctgccatcctgtgcgccaccagctcctagcagcaccgagcgggaacagagcgtgcgcaaatcctccacgtttcccaggacaggctatgactcggtaaagctctatagcccgacctccaaagccctgacccgcagcgatgatgtctccgtctgcagcgtgtccagtcttgggacagagctgtccaccacgctgtccgtcagcaatgaggacatcttggaccttgtggtcacgagcagctccagtgccattgtgaccctggagaatgacgatgacccacagtttaccaacgtcaccttgagctctatcaaggaaacccgtggcttacaccagcaggactgtgttcatgaagctgaggaggggagtaaattgaaaatattggggccatttagtaacttctttgcaaggaacttgcttgctagaaaacaaagtgcaaggcttgacaaacacaatgacttgggatggaagttatttgggaaagcgccactccgagagaatgcccagaaggattcaaagagaatacagaaggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggcagccgagaagaacagacgctctttaagtttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttttccagagctggaggtcacgtttctaaaactcacctacgaaagatagcattaaaggaacaggggctctctgaggatggccactgatgtgtgtttgtggatacctgggcatcgacccagcctgcaggtgagctctgggccatgttgccttgacacagtcacagtgtagaggctgcaggtgcacacgtgggctccagtgggactgcgctctgggagactgctccctggcatcggtcctgcggaggtggaaagttcgagaggaggagctatttgcgaggaagccctgtggcaatagagataggcttaaaagcggagagaacacagagtggaatcagccccctgtaagtaaaagggtagagaaagagatgtgtggctgggccctctcccacctgcctgttcagtggaggccagggcagcagcccagaacagcacatgtgggggaggtggccccttgtgccagcagtggctcctctctgcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgttactta

SEQ ID NO: 189475 - DNA, 4021 bp, Homo sapiens
  Payload ID: 17415
  Gene Symbol: TBC1D14
  Gene Name: TBC1 domain family, member 14
  ENST ID: ENST00000446947
  CDS Start-End: 235-1296
atctgtcctcaacagccgaagcttgctgtgcatgctgctgatgcgctctcctccctggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggcagccgagaagaacagacgctctttaagtttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttttccagagctggaggtcacgtttctaaaactcacctacgaaagatagcattaaaggaacaggggctctctgaggatggccactgatgtgtgtttgtggatacctgggcatcgacccagcctgcaggtgagctctgggccatgttgccttgacacagtcacagtgtagaggctgcaggtgcacacgtgggctccagtgggactgcgctctgggagactgctccctggcatcggtcctgcggaggtggaaagttcgagaggaggagctatttgcgaggaagccctgtggcaatagagataggcttaaaagcggagagaacacagagtggaatcagccccctgtaagtaaaagggtagagaaagagatgtgtggctgggccctctcccacctgcctgttcagtggaggccagggcagcagcccagaacagcacatgtgggggaggtggccccttgtgccagcagtggctcctctctgcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgttactt

SEQ ID NO: 189476 - DNA, 541 bp, Homo sapiens
  Payload ID: 17415
  Gene Symbol: TBC1D14
  Gene Name: TBC1 domain family, member 14
  ENST ID: ENST00000427736
  CDS Start-End: 372-541
gaaaagttttcctactccgacgcgaggctcccggcctgagaagaggcgcctcggtgcgccagaccccgaccccggagcccccttccacctcggaccctcagtccccaggcagcggaccctcctccttggagcccctgaccccgctttcatctctgacccctctacccctggagcccctgacccgcgaaaccccctttcatctcggagccctgacctccttggacctccacccacgcgaaccgtctgtccctgggctagggaatctctctgcctccgccttggagcctcccattaccgggccgcgaagaccctggcccggggactgtctcggggccggggtagctgccttgaggatttctccttggaccaagatgactgatggaaaactctccacctctacaaatggcgtagccttcatgggtattctggatggtcgaccaggaaacccccttcagaacctgcaacacgtcaatctcaaggcgccccgactcctctccgcgcctgagtacgggcccaagctgaaactcagggctttagaaga

SEQ ID NO: 189477 - DNA, 663 bp, Homo sapiens
  Payload ID: 17415
  Gene Symbol: TBC1D14
  Gene Name: TBC1 domain family, member 14
  ENST ID: ENST00000444368
  CDS Start-End: 282-663
atagattaagagactgaggctggctgggaggacgccacggcgccgctcccaagaccaccgcggcggggcctgagctccggtgtcacgcaaagcttcccttccgcggcggggcccgggccgtctcccgcacaccggccggggcaggggagccccatcgatgcgctccgccgctcggctccctacgcctgagccctgcccgctcgagccccttccccctcccggccgcttcccacttccaagatggctgcgggtggagccgaccagtttctccttggaccaagatgactgatggaaaactctccacctctacaaatggcgtagccttcatgggtattctggatggtcgaccaggaaacccccttcagaacctgcaacacgtcaatctcaaggcgccccgactcctctccgcgcctgagtacgggcccaagctgaaactcagggctttagaagaccggcacagcctccagtccgtggactcggggattcctaccctggagatcgggaacccggagcctgtaccctgcagcgcggtccacgtgaggaggaagcagtccgactccgacctcatccccgagcgggccttccagagcgcctgcgcgctgccatcctgtgcgccaccagctcctagcagcaccgagcgggaacagagcgtgcgcaaatcct

SEQ ID NO: 189478 - DNA, 2159 bp, Homo sapiens
  Payload ID: 17416
  Gene Symbol: TBC1D15
  Gene Name: TBC1 domain family, member 15
  Uniprot ID: Q8TC07
  ENST ID: ENST00000319106
  CDS Start-End: 92-2140
attaccaggcacgcgcaggaaacatggcggcggcgggtgttgtgagcgggaaggtttttggtttcttcttgattcaatcttgataagtagtatgtgtccaggactttatccatactccagtttgttggagtatggtaggagtatgattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcaaggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgctttttt

SEQ ID NO: 189479 - DNA, 566 bp, Homo sapiens
  Payload ID: 17416
  Gene Symbol: TBC1D15
  Gene Name: TBC1 domain family, member 15
  ENST ID: ENST00000498482
  CDS Start-End: 24-173
attaccaggcacgcgcaggaaacatggcggcggcgggtgttgtgagcgggaaggcgacattatcagcaagatattcaagaattttaacagatgattcgcttggtgacaggtggtgctacttcctcaaatctttgatctgttcttccctttctttttctcaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtat

SEQ ID NO: 189480 - DNA, 1223 bp, Homo sapiens
  Payload ID: 17416
  Gene Symbol: TBC1D15
  Gene Name: TBC1 domain family, member 15
  ENST ID: ENST00000491063
  CDS Start-End: 390-1223
attaccaggcacgcgcaggaaacatggcggcggcgggtgttgtgagcgggaagattcgcttggtgacaggtggtgctacttcctcaaatctttgatctgttcttccctttctttttctcaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagc

SEQ ID NO: 189481 - DNA, 1995 bp, Homo sapiens
  Payload ID: 17416
  Gene Symbol: TBC1D15
  Gene Name: TBC1 domain family, member 15
  ENST ID: ENST00000462788
  CDS Start-End: 24-398
attaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcaaggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaa

SEQ ID NO: 189482 - DNA, 640 bp, Homo sapiens
  Payload ID: 17416
  Gene Symbol: TBC1D15
  Gene Name: TBC1 domain family, member 15
  ENST ID: ENST00000472611
  CDS Start-End: 24-281
attaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacat

SEQ ID NO: 189483 - DNA, 363 bp, Homo sapiens
  Payload ID: 17416
  Gene Symbol: TBC1D15
  Gene Name: TBC1 domain family, member 15
  ENST ID: ENST00000468049
  CDS Start-End: 20-238
ccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaagatctccacaggataaaagaacacttcttgtgaattgtcagaataagagtctttcacagtcttttgaaaatcttcttgatgagccagcatatggtttaatacaaaaaattaaaaaggacccttatacggcaactatgatag

SEQ ID NO: 189484 - DNA, 2489 bp, Homo sapiens
  Payload ID: 17416
  Gene Symbol: TBC1D15
  Gene Name: TBC1 domain family, member 15
  Uniprot ID: Q8TC07
  ENST ID: ENST00000485960
  CDS Start-End: 24-2048
attaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcaaggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaactaattatttttgtagttacttctaccaaatagcctttccttttcgataacattcctcagtatttttatagccaagtacattttattttcttgctgatgaactggaattggataaatattgcaagtggatgagttggaaattatgcactttgaaaaacattcactttgtttaagcttattgggtttcagatttgattaaattaaatgtggaggctttctatagcattctaagctgagaagtagattgttacccagtaatgaaataaaaaataaaaataaaagg

SEQ ID NO: 189485 - DNA, 6184 bp, Homo sapiens
  Payload ID: 17416
  Gene Symbol: TBC1D15
  Gene Name: TBC1 domain family, member 15
  Uniprot ID: Q8TC07
  ENST ID: ENST00000550746
  CDS Start-End: 65-2140
gttgttgtatgtccgagagacacgtgaggttctgctacgtcattaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaagcaggactgctagacagaagaaagctgttgtgggccattcaccactggaaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcaaggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaactaattatttttgtagttacttctaccaaatagcctttccttttcgataacattcctcagtatttttatagccaagtacattttattttcttgctgatgaactggaattggataaatattgcaagtggatgagttggaaattatgcactttgaaaaacattcactttgtttaagcttattgggtttcagatttgattaaattaaatgtggaggctttctatagcattctaagctgagaagtagattgttacccagtaatgaaataaaaaataaaaataaaaggatttttttctctattgtttacgacagtactcagcttaaatatttatgctggtcaaatgtgatttaaattggacattttcatcaatgcagtctaatgtgtagataaatatttcaaccataataagtggattggcagtatattttttacattgaacttttcttcacttgtatataaagattatatataagtacttatttatgagtataagaaaggttaggcatattttcattaactgaataaacgacttgatttatataacctggtttatcaaaatttaacatggcttcagtatgagatctttttcaaaactattttcttaaacatttatttcatgagattatgttcaaccctgtacctggtgtaattttaaaattaattgcttgtaacctcactttactaataatgtttattatctttcctaataatgcattaactgattaatcaggtgtttaaatttttataaaatactcttgcaaaaagtttatttgaaaaatttctagatggtctcatgagtttcaaaataataatttttgtgtatgaacaaagctgttgtttttaccatgcagtattgcatgattttaagttatgtggaattaacataactgattttgttttaattgtaagttgttaactcctgtatatatcattaaaataaatctgaagttgaagtagtgtttttagttaaattatacttagaaatagtctgcttttttaaaattttttttcttgagaaagagtcttgctctgttgcccaggctggagtgcagtggcgcagtcctggctcactgcagcctccgccttctgggttcaagcgattctcctgtctcagcctcccgagcagctgggactacaggcttgtgccatcgcgcctgactaatttttgtattttgagtagagatggggtttcaccatgttggccaggctggtctcgaactcttgacctcaagtgatccactcgcttcagcctcccaaagtgctgagattacaggtgtgagccactgtgcccggctaattctttaatagaagaaaaaacatccaagatggacctcaattcatctcttatttttatatgattaaaatgataatctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaatgataatctgaataagttatggaaatgaaaaccatcctttttataactgaaaaaaaattttcattagcatggaaatgggcacagtgttgccttgaaagatacagttatttgactcagtaaagcagcttattacaactgatgctaatagtatagagaaaaaagttgtgcagttctaaaatggtcctagagattgacttttttcccccaagaaagttagggaacaaaacgaacttttttcctggttgagcattaactgacaatcacgacagtagaaccgttagagtttagtttttaatattatgtgtgttatctttcatcagttaataatgagtaagcctattcagaaaaagaacataaactgatcaaaaactcagcatctccagcctttcatttcctgctattcaggaaattgcttagaacatcttgatgtcctccttgttcttcctggacagtgactttttgggagtttgttcctgctgcgtaatgtgatacccacttcagattttttttttatcaatacatttagtaagttgaacttctgtcaagttttattacaaaattacttgttaaaacaatttttactaaactgcatttctatctagcatatttttgatatggaagtgatagtatagtatagttccaggagaagtcttaaatcagtccacagagtccagttagcaaatactctgtgccattaagattgctaaaatacacagttcaggtaaatttactagtgttttttaaaggtttatttgttttcacaagatgctctgtccacacccttataacatgtaaaatattgtgtgctgtattatgtggtaaagttgttaaaattcagtttctaacattaacttaaaagtacagacaatctaacatgatgatttgacttacaaactttcaactaaatttatgatggctttaaagcagtgcactgaatagaaaccatactttgagtacccatacagccatttttcacttttactacaatattctataaatcacatgagatatttaacactttattataaaataggctttgtgttagatgattttgcccaaatgtaaactaatgtagtgttctgagcatgtttaagttagggtaggctaaactatgtttggtaggttagatgtattaaaagcatttttgattaatgatgtcttcaatttatgatgtgtttattggaacataacctcaatataagttgaaaagcatatgtattttcaattctggcatgaacctatgggaatcttttgcatttaagaacctccccattttaataatttcatgggtctaagattcttcatctgtttataaggaactttagtcttagtgattagagactaaatttttttttgagcagtaagaaaacagccttttgggacagatagtgagtgattcttaggaacttgacattgccaagaaattttatagatgccgaagaattcttatgtgaaattcacataagcatgcccattactaaagacagtttgtataaagtaaccctaaatgtttattgaggaacctacagcttcaactgacttacgtgcagatatgtaccaggagaacatcattttagcttgggcgtctttacttggggttttcagaggatccaggaacctcactgtatgcaaagtcttgtggatgtacctgaatgtttttggaggcaggtcacatagtttctgaaagtgttctcttattttcctcaaatgtaggtaaccattgttacaagttatttaacaggagaatagtaacaatgtctaacttatgctaatgattttgtgtgctgagctcccattaattaaaatgtcttcagaatgcttgtttccagatccttggtctgtattattaagatacatgtctaggtgctacttcaggcttacagaatcagtctttggaagtcagatcaggaatctgcattttaacaagcatccaggtgatttcttgagcccctctgaagttagagcactaccattatatattgtatttcatatgttaatcttttgatttatggccaagtggacaattcccttaatttttaaaagcttgtcccttgattttctaagatatttgctctagttccggtcgccatttttagtaaaaagtgatgacagctcagcctgttatatgtagatttctcatttcttactttctgaagaaaattaagctttctgtgtcacttctgagcacgaaacaagattaaattattggaatctg

SEQ ID NO: 189486 - DNA, 863 bp, Homo sapiens
  Payload ID: 17416
  Gene Symbol: TBC1D15
  Gene Name: TBC1 domain family, member 15
  ENST ID: ENST00000482439
  CDS Start-End: 504-863
ttttgccggatgttgttgtatgtccgagagacacgtgaggttctgctacgtcattaccaggcacgcgcaggaaacatggcggcggcgggtgttgtgagcgggaagggtggatgctgatatactgcttgacttactgcgtatttgaagattatcctgtttgattttccatctaaactgatccaggctgggacttttcaagaggggatcccttccgtttaaacatctccctctttcagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaa

SEQ ID NO: 189487 - DNA, 10936 bp, Homo sapiens
  Payload ID: 17417
  Gene Symbol: TBC1D16
  Gene Name: TBC1 domain family, member 16
  Uniprot ID: Q8TBP0
  ENST ID: ENST00000310924
  CDS Start-End: 117-2420
gacggtggcggctctcggagccggcgcgaatccggcccccgcagcgggacccgggcaggtcttgacgagccctgcccgggccgacgcatgcggaggatggaaacacttgcccggcaatgtctctgggccgcctccttcgcagggcctcctccaaagcctcggacctcctgaccctcacccccggtggcagcggcagcgggtccccctctgtcctggatggagagatcatctactccaagaacaatgtctgcgtgcacccgccggaggggctgcaggggctgggggagcaccacccaggttacctgtgcttgtacatggagaaggatgagatgctgggagccaccctcatcctggcatgggtccccaactctcgcatccagaggcaggacgaggaggccctgcgctacatcacacccgagagctcccccgttcgcaaggcaccccgccctcggggccggcgcacccggagctcaggagcctcccaccagccctccccgacggagctgcggcctaccctgacccccaaagatgaggacatcctggtggtggcccagagtgttccagaccgcatgctcgccagccctgcgccagaggatgaggagaagctggcgcagggcttgggggtggatggtgcccagccagcctcgcagcctgcttgcagcccctccgggatcttgtcgacggtcagtccgcaggatgtcaccgaggaggggcgggagccgcggcccgaggccggggaggaggatggctctttggaactgtcagccgagggcgtgagcagagacagctcctttgactcagactcagacaccttctcctcgcccttctgcctctcgcccatcagcgcggcgctggccgagagccgcggctccgtgtttctggaaagtgacagcagccccccgtccagctccgacgccggcctgcggttcccggacagcaacggcctcctgcagaccccacgctgggacgagccgcagcgggtgtgcgccctggagcagatttgcggcgtgttccgcgtggacctgggccacatgcgctccctccgccttttcttcagcgacgaggcctgcaccagcggccagctggtcgttgccagccgagagagccagtacaaggttttccacttccaccacggcggcctggacaagctgtctgacgtgttccagcagtggaaatactgcaccgagatgcagctcaaagaccagcaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccaggtcgtccagcaggtacttccaagttcccaggtctgtctgcctaagagccttttgaggagaccgtcctggagccccatcagtgcccagatcctggggtaccgaccattgctgtctagcagtgggggatcctgtggtgggaatggggtgggcttctcatccatgttgcttctgggaagagagggttgcctttctgggctagggaggtggctggagcttctgccctgaccctccgctagaaaccagttatatccattgccacagcaatactgtgtaacaaatccgccaacactcggtggcctgcaacagtcagcactgatctagggcaggagtcagcagtctgggcagggtgattcttctggtctaggctgggcttgtttgtttagggccagtgggttgttaagtcccaggggatgctcatggtgcagaggtcggacctggccctgctctgtggtctcttgcatccctcctgcaggccagccatggcacagccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgagctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcaacgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgtctgcttcttgtttggcagaaatagatgtggggcacagcccctagatgatgggaatctgcccaagctgtgccctctggggaatgaaatcttgctcctcgtgcagcttcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcgcacacacacacacacacacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggagtgcattggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttgttttggtttttaaatgtaatcacccattggtcaggcccaggactggtcaccatgagctctgctagccacggccccaacgatgcttccggctctcatggattccacagcaaataaaactgtactgacaacagatgcacgctgtacagtgcctctggaaggtgcggtgggacttgctgggtcaaagcacggcaggctctgtgctgggcaaacagggccccgtggcagcccaagggcagcctgcagacgccagtgtgcccggcttctcccatgttctgagatgggggaggggaaggtgtaaaagagagctggatgggggctgtggggactgagggtcctgggaggctggccaggggctcagcaagcgcccactttgggaggccttgccctctgggctgtggttggacagcactaggcctgcaggctgggctgccaggaggaagagcagctccggacctcaggcccccccagcaggcggcgatggagggtgatgggagaattgacgagtgctcgcggggtctcactcgggaaagggccggttaactctgagcaactgggagcctcgctcccaccccagtgcctggaaacacaaacagtattttattgagccttggctgccggggctctggtttcaggaaaagcctcagtcctgcatttgtgaatttttaaggaggcaaacaaggtgaatttgaccttcctaggagtgggagttagggaaaattcaggctgccctaccaagcccttggaaccgtgcagcaggggtcaggggagggatgggcaaaggcggtttggcccatggagcaggtctcctggtcctcccggagcacggggggcggggagctccagctcttcatcaagcgccctttggggtttccaactgttttctgttgttctctgtgtgtcttttccccttttgcctgggggcgggggctggaggggaacatacctcttatctacatcactcgggtctcatgtctgaagggcctgtctcacctgccacctacctggccttggcctcgacatctgagcgcctcatcacctcctctccacatgcccaggggtgcccctcccaaggctggctgggcaggtcccacggactaggccccaggaggagcagtgggcttcccccaggaaagagcagagccagcactgcctgcctagggagggcacccactaccaggcatggctggtggctccgtttaaagaaatctttgtccatgtgggagtgggaggtgcttccccatcctgcctggaagccacgtcctggctcttaccgtggactctgcaacagccgtggtggccacatgaagatggaggaacctggtggctcaggggcccctgatgtcaccgcctccaaggcaacgggactgggcagggcagctcctcaggaaggatgatcccacctgcacgggtcagccctgcagggggacaaggcccaccacaaccccacctcaggccaccaactggacctgtcctgccaagaaggtcccttccaatttgtccggcagctggttccctggatacagcccagacgcagcatcatcctcatgttcacctctgctgtgccctacttcccccgtaaatgacaactgtgtagtcacccacgccgggcaagagaacataggtgccacctggcgggccacacttttcaggggccgtgcctcgggcaggcccggctctctgttgtcccgcagccctcagggctggcggtggctgctcagtgcctagggagtgcccttgccacacagctgggcagcgagcatgactcagcgtttacactcaaccagccgcacaggctccagaggggaagttctctggggtccttctatgagagagcatcctgtctgcagccctgttctggctccttccacatcattcatgcattcatcccacgaggactatggtaccgtgggctcgctctagggaagcaaggcaggagcgcactggggctacttggattcccggggcagacacatatgtaccctgcacaccctcaaatgagcaaagccaccccactggcccctgggtgaggccatgtggacccccacacctttggggccggctgggcaaaccttgaacccccaatttctgcgtggcctttggctgccctccttctccaaggcgtgactcttactccagagactcaggcgagcacgtgtcccttaccttattttctctcaatcaaactgaaacccattgtgatcccccatagtccagtgcggtctctgttattattacgggtgtctcccttcctccccgtgcccaggacaggccatgagccagagatacaaggggccccaggcaagatgcagggctctctgctcctggctctttatcgtcgtcgggacaccctttgtccaaactcaaggaatcccgggaggtctggctttgccgctttggctgggactcaggtacctgggcatacctgcatctgtgccccctcttcgtcccagtgagacggaccctcagtatcccccccaacatagaacaggaaggtctcaagccagccccctcctccagttcaatcaccctccctcacatccacccagagaagtccagacctgtggccacttccatgccctctccagaccaggagacacctgctgctgacctcgtggaaaacttagattttgacattctgatgcttcggaagtggtggctcctcctccttcacccctccgccacctgtgggcctcctctctgcatctcaagagaacaaccagatctttgggctcctggggtgtgtgccatgcaatttagacgaagtgctttgaaaatatgccattcagtctctgactaggaaaataagtctgacctgataggtccgatgtcatcagctcttcaacatgagacaaaagaggggattttatgttttgagtcattagaatgatataataattttctgaattgacatctggatgttgaaattaggatggtgcaaaaggggtccagggcctcaggctgggcgcagcagccagctcccaatgacgcagaagctgcttcaaaaccccctcaacaaagaggggcacatgcaagtcaccaaagtgggaagccttcaccaaggccacacccaaagtctactgattgtctgtccaaagttcgttgattcctggccatgaacaagcacaatagaaaaagacacagggtcctagtggctacaagtcaatgtgaattggcacatggtctagcagttttaaaatctgacagtagagtatggcaatgggcaagggccaagaagtcctgagatgggaggtcagcgctctaactgggctcagtggaggtctgtgaccagtgtctggacactagctacaggggaccgggcagaggattctgggcagaaggaaaatgtctaaaagtactttgggagggtaaaggacaggggccttatttaaaataaagactgaaggataataagtgtca

SEQ ID NO: 189488 - DNA, 4244 bp, Homo sapiens
  Payload ID: 17417
  Gene Symbol: TBC1D16
  Gene Name: TBC1 domain family, member 16
  Uniprot ID: Q8TBP0
  ENST ID: ENST00000340848
  CDS Start-End: 76-1293
ggggttggagagagtggggggcggcggcacagtgggccggggaggagagagccgcagagggaaaccgattttaagatgaaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccaggtcgtccagcaggtacttccaagttcccaggtctgtctgcctaagagccttttgaggagaccgtcctggagccccatcagtgcccagatcctggggtaccgaccattgctgtctagcagtgggggatcctgtggtgggaatggggtgggcttctcatccatgttgcttctgggaagagagggttgcctttctgggctagggaggtggctggagcttctgccctgaccctccgctagaaaccagttatatccattgccacagcaatactgtgtaacaaatccgccaacactcggtggcctgcaacagtcagcactgatctagggcaggagtcagcagtctgggcagggtgattcttctggtctaggctgggcttgtttgtttagggccagtgggttgttaagtcccaggggatgctcatggtgcagaggtcggacctggccctgctctgtggtctcttgcatccctcctgcaggccagccatggcacagccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgagctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgca

SEQ ID NO: 189489 - DNA, 683 bp, Homo sapiens
  Payload ID: 17417
  Gene Symbol: TBC1D16
  Gene Name: TBC1 domain family, member 16
  ENST ID: ENST00000574427
  CDS Start-End: 119-683
gttggagagagtggggggcggcggcacagtgggccggggaggagagagccgcagagggaaaccgattttaagatgaagttttcctcccgtccagcaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcaga

SEQ ID NO: 189490 - DNA, 961 bp, Homo sapiens
  Payload ID: 17417
  Gene Symbol: TBC1D16
  Gene Name: TBC1 domain family, member 16
  ENST ID: ENST00000570373
  CDS Start-End: 74-913
ggttggagagagtggggggcggcggcacagtgggccggggaggagagagccgcagagggaaaccgattttaagatgaagcaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagggggctgatgtctgatgaaagcgagtctgaagccaccgagtgccggtaccacacgccgccttt

SEQ ID NO: 189491 - DNA, 1141 bp, Homo sapiens
  Payload ID: 17417
  Gene Symbol: TBC1D16
  Gene Name: TBC1 domain family, member 16
  Uniprot ID: Q8TBP0
  ENST ID: ENST00000572862
  CDS Start-End: 68-904
agagagtggggggcggcggcacagtgggccggggaggagagagccgcagagggaaaccgattttaagatgaaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagggggctgatgtctgatgaaagcgagtctgaagccaccgagtgccggtaccacacgccgcctttgcatgcggtcatcggctcgcccctggcccgggtctaggtttccctcctggctcagcctgctggacgtggacgtgcagggtggacgatctgcattaacgaagggaagcacggcatggacggtctgagaggcttcattcccaccactcccgaattaaaaaaaatcgtgcctcattgcacgttttcccagtg

SEQ ID NO: 189492 - DNA, 567 bp, Homo sapiens
  Payload ID: 17417
  Gene Symbol: TBC1D16
  Gene Name: TBC1 domain family, member 16
  ENST ID: ENST00000571872
  CDS Start-End: 176-567
taacccagcacctgatgaaatcttccctgaaagttgcagccccccgtccagctccgacgccggcctgcggttcccggacagcaacggcctcctgcagaccccacgctgggacgagccgcagcgggtgtgcgccctggagcagatttgcggcgtgttccgcgtggacctgggccacatgcgctccctccgccttttcttcagtcagggctgcccagccgcagacatcaccaatgagaggcccgggcttagaagaagccggcgtgtccagaagctgggggggttcccagacccagagccacattccagcctttcatctaagggcagccggggctgggctgacagcactgacggatgtttactgagtttccctggagggttctcccagagttccacccacacgcaacgaaggagcgacgaggcctgcaccagcggccagctggtcgttgccagccgagagagccagtacaaggttttccacttccaccacggcggcctggacaagctgtctgacgtgttccagcagtggaaatactgcaccgagatgcagctcaaagaccagcaggtcgc

SEQ ID NO: 189493 - DNA, 685 bp, Homo sapiens
  Payload ID: 17417
  Gene Symbol: TBC1D16
  Gene Name: TBC1 domain family, member 16
  ENST ID: ENST00000573782
  CDS Start-End: 116-685
ggagagagtggggggcggcggcacagtgggccggggaggagagagccgcagagggaaaccgattttaagatgaagttttcctcccgtccagcaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaa

SEQ ID NO: 189494 - DNA, 6342 bp, Homo sapiens
  Payload ID: 17417
  Gene Symbol: TBC1D16
  Gene Name: TBC1 domain family, member 16
  Uniprot ID: Q8TBP0
  ENST ID: ENST00000576768
  CDS Start-End: 97-1275
attcattccgtttttgcggctggggttggagagagtggggggcggcggcacagtgggccggggaggagagagccgcagagggaaaccgattttaagatgaagcaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactgctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccaggtcgtccagcaggtacttccaagttcccaggtctgtctgcctaagagccttttgaggagaccgtcctggagccccatcagtgcccagatcctggggtaccgaccattgctgtctagcagtgggggatcctgtggtgggaatggggtgggcttctcatccatgttgcttctgggaagagagggttgcctttctgggctagggaggtggctggagcttctgccctgaccctccgctagaaaccagttatatccattgccacagcaatactgtgtaacaaatccgccaacactcggtggcctgcaacagtcagcactgatctagggcaggagtcagcagtctgggcagggtgattcttctggtctaggctgggcttgtttgtttagggccagtgggttgttaagtcccaggggatgctcatggtgcagaggtcggacctggccctgctctgtggtctcttgcatccctcctgcaggccagccatggcacagccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgagctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcaacgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgtctgcttcttgtttggcagaaatagatgtggggcacagcccctagatgatgggaatctgcccaagctgtgccctctggggaatgaaatcttgctcctcgtgcagcttcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcgcacacacacacacacacacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaataatgatgcctgcctgcccaggccacctcctgggagtgcattggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaa

SEQ ID NO: 189495 - DNA, 770 bp, Homo sapiens
  Payload ID: 17417
  Gene Symbol: TBC1D16
  Gene Name: TBC1 domain family, member 16
  ENST ID: ENST00000574241
  CDS Start-End: 1-770
agagttccacccacacgcaacgaaggagcgacgaggcctgcaccagcggccagctggtcgttgccagccgagagagccagtacaaggttttccacttccaccacggcggcctggacaagctgtctgacgtgttccagcagtggaaatactgcaccgagatgcagctcaaagaccaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggtctggcccttcctgctgcgctattacagccacgagtccacgtcggaggagcgggaggcgctgcggctgcagaagcgaaaggagtactctgagatccagcagaaaaggctctccatgactcccgaggagcacagagcgttctggcgtaatgtgcagttcactgtggacaaagacgtggtccggacagatcggaacaaccagttcttccggggggaagacaatcccaatgtggagagcatgaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactg

SEQ ID NO: 189496 - DNA, 2366 bp, Homo sapiens
  Payload ID: 17418
  Gene Symbol: TBC1D17
  Gene Name: TBC1 domain family, member 17
  Uniprot ID: Q9HA65
  ENST ID: ENST00000221543
  CDS Start-End: 300-2246
aggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagctctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctca

SEQ ID NO: 189497 - DNA, 2025 bp, Homo sapiens
  Payload ID: 17418
  Gene Symbol: TBC1D17
  Gene Name: TBC1 domain family, member 17
  Uniprot ID: Q9HA65
  ENST ID: ENST00000535102
  CDS Start-End: 59-1906
gacaacacgctgactaggaaaaggaggaggcggggcagtggggccttcggcggcgactatggaaggagccggctacagggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagctctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctc

SEQ ID NO: 189498 - DNA, 1161 bp, Homo sapiens
  Payload ID: 17418
  Gene Symbol: TBC1D17
  Gene Name: TBC1 domain family, member 17
  ENST ID: ENST00000594996
  CDS Start-End: 23-250
agtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggggccggaagtcagtcggcacccacagagctagtgacgagacactggaaggctgagctgaccacctgcgctgccccagggcaggaggatgaagatgaagatgaagatgactctccaccttgctccacagccaaacacagccaaggcaccaggaagttgcgttacatcacttccgctttccaggactccagtgggggtgactcatgtgcttctgaggaggaaccaacctttgaccccggctatgaacctgactgggctgtcatcagcactgtgcggccacagctctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcc

SEQ ID NO: 189499 - DNA, 1441 bp, Homo sapiens
  Payload ID: 17418
  Gene Symbol: TBC1D17
  Gene Name: TBC1 domain family, member 17
  ENST ID: ENST00000594984
  CDS Start-End: 1-1035
accaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacgaagcacagagtgggcgctcgggcggaggtggttgagtgccgactggcgcctgacccaccccctcccgcagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccc

SEQ ID NO: 189500 - DNA, 1742 bp, Homo sapiens
  Payload ID: 17418
  Gene Symbol: TBC1D17
  Gene Name: TBC1 domain family, member 17
  ENST ID: ENST00000599049
  CDS Start-End: 1-1441
gaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagctctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctgggcacagtggctcacacctgtaatcccagcactttgggaggccaaggcgggcggatcacttgaggtcaggagttcaagaccagcctgaccaacatggagaaactgtctctactaaaaatacaaaattagctgggcctggtggcacacgcctgtgatcccagctactcaggaggctgaggcaggagaatcgcttgaacctgggaggtggaggctgcagtgagccaagatcacaccatggcacttcagcctgggcaacaagagcgaaagaaactccatctcaaaaaaaaaaaaaaaaaaaaatatattctttattacttggtcaatgtaaaaactgcaggaaattaagatgaagaagaaaaagtaa

SEQ ID NO: 189501 - DNA, 2370 bp, Homo sapiens
  Payload ID: 17418
  Gene Symbol: TBC1D17
  Gene Name: TBC1 domain family, member 17
  ENST ID: ENST00000622860
  CDS Start-End: 1347-1973
aggtggtgcagctctcagaccctcccacttgtttacttcgtggcgagagggcgaacactgcgcctgcgcactctccgtagccggatccaccttcagcgtctgcgccacgtgactccgatccaccctcgaggttccagtggaataacccccttctgaaaaatggtttcacccgctccttctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagctctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccacaaggtcctccggcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcatgtgc

SEQ ID NO: 189502 - DNA, 2263 bp, Homo sapiens
  Payload ID: 17419
  Gene Symbol: TBC1D19
  Gene Name: TBC1 domain family, member 19
  Uniprot ID: Q8N5T2
  ENST ID: ENST00000264866
  CDS Start-End: 279-1859
tttcaaccatagacaaggcaggaacaacggtgtgaaaagcgtcctccccgccccggtctttttccgccggcggaacgcagatgctgtggccttcaggcgctgaggggaccagagagggacggacacaaggctcggcagttgcctggtaacgcccgctggaggagtcccagtgtaataaggtcccggagaagtgtcactggccctgagtgggacccggtagcccgttcgctccgcgccggcggcctgtccccgcggcttggcgggctagggcaggggaaatgttgcaggaggagtcggacctctctctcattattgcccagatagtccaaaagctcaagggctccaatttgtactctcagctggaacggcaggcctgggccagtcttcagagacctgagattaaacttgaatcactgaaagaagatattaaggaattctttaaaatatcaggttgggagaagaaacttcagaatgctgtttatagtgaactgagtgtgtttcctttacctagtcatcctgctgcacctcctgaacatcttaaagaacctttggtatacatgaggaaagcacagggaagttgggaaaaaagaattttgaagagtttaaatagtatgtgcactgaactgagtatcccactggcacgaaagaggccagttggagaacagaaagaacttcttaataaatggaatgaaatgggaactgatgaaccagatttaagccttttcagacctgtttatgcacctaaggattttcttgaggtattaattaatcttcgcaacccaaattatgaaaacggtgattctcttagtttcaggactcatttgggtttaattcaagttccactgaaagtaaaagacatccctgaattgaaagaatgctttgtggaacttggcttaaatataggacaactgggtatagatgattctacacaagtgcctcctgaactttttgaaaatgaacatgtacgtattgggcaaaaagttctagcagaacaagatagtgctgctgctcaacagtacatcagacaaggaagtcccacggcactgagagctgaattgtgggctctcattttgaatatttccagccaacctgaggatgtcttgtattatgagcagcttaagaccaatgtgatacaacatgaccttttggtggacagtctaatctataaagatgtgaagttgacagcaagcaatgatgattattattttgtatttgaagattatttatatcaggtattactttgtttttcccgggatacatctgtgttgagtcactttgcattcaacagtgcctcgccaccaaaatcatacataagaggaaaactaggactggaagaatatgctgtcttttacccaccaaatggtgttatcccttttcatggattttcaatgtatgttgcaccactttgttttctataccatgaaccttccaaattgtatcagatattccgtgagatgtatgtgcgttttttcttcagactccattccatctcttctcatccttctggtattgtgtcactctgtctgctgtttgaaactcttcttcaaacttatcttccccaactcttttatcatctacgagaaattggggctcaaccacttcgcatatcatttaagtggatggttcgagctttctctggatacttagctacagatcagctcttgcttttatgggatagaatcctaggatacaactctctggaaattcttgctgtgctggcagctgccgtgtttgctttccgagcagtgaacctgatggaggtgacatcactggctgcagctgaagcagttcttgctgacctttctactttaaaagttatgcctcttcttcagatttttctgtttgctactgtcacctgatcttcttcacagtcactggcaacacatctagtttttcattagaaacaaatcatgaactatgcaaactctgcataaaaccaaaatgaaactttgcatataagccaataaagatcatgttccctcttcagttaaacctaagtagtttctcactttttgaaacaataactctgcaccaaatattgcatcgcatgctgctgattttcaagagagaagcaataaacacaacttctgctaaattgagcattatatatataatattataatatatatataatcctgacttgtcaatggcatgtaataatatatgcaataagaactaaagatactgtaataaacttcaagaggtaatgtagcttcttggataattcttttatgtcagtttataaatttatctctagataatg

SEQ ID NO: 189503 - DNA, 774 bp, Homo sapiens
  Payload ID: 17419
  Gene Symbol: TBC1D19
  Gene Name: TBC1 domain family, member 19
  ENST ID: ENST00000505206
  CDS Start-End: 106-774
aataaggtcccggagaagtgtcactggccctgagtgggacccggtagcccgttcgctccgcgccggcggcctgtccccgcggcttggcgggctagggcaggggaaatgttgcaggaggagtcggacctctctctcattattgcccagatagtccaaaagctcaagggctccaatttgtactctcagctggaacggcaggcctggggaagttgggaaaaaagaattttgaagagtttaaatagtatgtgcactgaactgagtatcccactggcacgaaagaggccagttggagaacagaaagaacttcttaataaatggaatgaaatgggaactgatgaaccagatttaagccttttcagacctgtttatgcacctaaggattttcttgaggtattaattaatcttcgcaacccaaattatgaaaacggtgattctcttagtttcaggactcatttgggtttaattcaagttccactgaaagtaaaagacatccctgaattgaaagaatgctttgtggaacttggcttaaatataggacaactgggtatagatgattctacacaagtgcctcctgaactttttgaaaatgaacatgtacgtattgggcaaaaagttctagcagaacaagatagtgctgctgctcaacagtacatcagacaaggaagtcccacggcactgagagctgaattgtgggctctcattttgaatatttccagccaacctgaggatgtcttgtattatgagcagcttaagaccaatgtgatacaacatgac

SEQ ID NO: 189504 - DNA, 567 bp, Homo sapiens
  Payload ID: 17419
  Gene Symbol: TBC1D19
  Gene Name: TBC1 domain family, member 19
  ENST ID: ENST00000513455
  CDS Start-End: 364-567
ccaggggctgcagtttgattttgccacctttccttttcgttaacaaaagtgctatttgacatatattttatgtgtagttccatgaactaaacttcattttgtttggggaatctggaaagaatctcacactttgtttgaggctctacacaacaaatcactggattgaaattcctgcggggggggcattctggaagggactttggaccccgctcaagaagtcagtccccaagagtggagtccaattcagcagagaattcacggacagaagaacaacacagcagggcagagagccacagagccactagcagatgtcagggagatgaagagaggggccacagtaaaataagactctgggatgaaggtatgaccaggacaagggccaggtatgaccaggccagtcttcagagacctgagattaaacttgaatcactgaaagaagatattaaggaattctttaaaatatcaggttgggagaagaaacttcagaatgctgtttatagtgaactgagtgtgtttcctttacctagtcatcctgctgcacctcctgaacatcttaaagaacctttg

SEQ ID NO: 189505 - DNA, 580 bp, Homo sapiens
  Payload ID: 17419
  Gene Symbol: TBC1D19
  Gene Name: TBC1 domain family, member 19
  ENST ID: ENST00000513596
  CDS Start-End: 229-580
ttttgttgatatttcagtagttctgttcctttttattgctgagtaatatttcagtgtttgaatgtacaatggcttgtttattcatcattgtgtgaagggcattgggttgctttctggttttagagattataagtaaagctgatatatacattctagtatacgattttgcttggatatttgtttctttttttcttggataaatacctaggattggaattgctgacttgtatggccagtcttcagagacctgagattaaacttgaatcactgaaagaagatattaaggaattctttaaaatatcaggttgggagaagaaacttcagaatgctgtttatagtgaactgagtgtgtttcctttacctagtcatcctgctgcacctcctgaacatcttaaagaacctttggtatacatgaggaaagcacagggaagttgggaaaaaagaattttgaagagtttaaatagtatgtgcactgaactgagtatcccactggcacgaaagaggccagttggagaacagaaagaacttcttaataaatggaatgaaatgggaactgatgaaccagatttaagccttttca

SEQ ID NO: 189506 - DNA, 1386 bp, Homo sapiens
  Payload ID: 17419
  Gene Symbol: TBC1D19
  Gene Name: TBC1 domain family, member 19
  Uniprot ID: Q8N5T2
  ENST ID: ENST00000511789
  CDS Start-End: 1-1386
atgttgcaggaggagtcggacctctctctcattattgcccagatagtccaaaagctcaagggctccaatttgtactctcagctggaacggcaggcctggggaagttgggaaaaaagaattttgaagagtttaaatagtatgtgcactgaactgagtatcccactggcacgaaagaggccagttggagaacagaaagaacttcttaataaatggaatgaaatgggaactgatgaaccagatttaagccttttcagacctgtttatgcacctaaggattttcttgaggtattaattaatcttcgcaacccaaattatgaaaacggtgattctcttagtttcaggactcatttgggtttaattcaagttccactgaaagtaaaagacatccctgaattgaaagaatgctttgtggaacttggcttaaatataggacaactgggtatagatgattctacacaagtgcctcctgaactttttgaaaatgaacatgtacgtattgggcaaaaagttctagcagaacaagatagtgctgctgctcaacagtacatcagacaaggaagtcccacggcactgagagctgaattgtgggctctcattttgaatatttccagccaacctgaggatgtcttgtattatgagcagcttaagaccaatgtgatacaacatgaccttttggtggacagtctaatctataaagatgtgaagttgacagcaagcaatgatgattattattttgtatttgaagattatttatatcaggtattactttgtttttcccgggatacatctgtgttgagtcactttgcattcaacagtgcctcgccaccaaaatcatacataagaggaaaactaggactggaagaatatgctgtcttttacccaccaaatggtgttatcccttttcatggattttcaatgtatgttgcaccactttgttttctataccatgaaccttccaaattgtatcagatattccgtgagatgtatgtgcgttttttcttcagactccattccatctcttctcatccttctggtattgtgtcactctgtctgctgtttgaaactcttcttcaaacttatcttccccaactcttttatcatctacgagaaattggggctcaaccacttcgcatatcatttaagtggatggttcgagctttctctggatacttagctacagatcagctcttgcttttatgggatagaatcctaggatacaactctctggaaattcttgctgtgctggcagctgccgtgtttgctttccgagcagtgaacctgatggaggtgacatcactggctgcagctgaagcagttcttgctgacctttctactttaaaagttatgcctcttcttcagatttttctgtttgctactgtcacctga

SEQ ID NO: 189507 - DNA, 912 bp, Homo sapiens
  Payload ID: 17419
  Gene Symbol: TBC1D19
  Gene Name: TBC1 domain family, member 19
  ENST ID: ENST00000512840
  CDS Start-End: 111-912
agcagagaattcacggacagaagaacaacacagcagggcagagagccacagagccactagcagatgtcagggagatgaagagaggggccacagtaaaataagactctgggatgaaggccagtcttcagagacctgagattaaacttgaatcactgaaagaagatattaaggaattctttaaaatatcaggttgggagaagaaacttcagaatgctgtttatagtgaactgagtgtgtttcctttacctagtcatcctgctgcacctcctgaacatcttaaagaacctttggtatacatgaggaaagcacagggaagttgggaaaaaagaattttgaagagtttaaatagtatgtgcactgaactgagtatcccactggcacgaaagaggccagttggagaacagaaagaacttcttaataaatggaatgaaatgggaactgatgaaccagatttaagccttttcagacctgtttatgcacctaaggattttcttgaggtattaattaatcttcgcaacccaaattatgaaaacggtgattctcttagtttcaggactcatttgggtttaattcaagttccactgaaagtaaaagacatccctgaattgaaagaatgctttgtggaacttggcttaaatataggacaactgggtatagatgattctacacaagtgcctcctgaactttttgaaaatgaacatgtacgtattgggcaaaaagttctagcagaacaagatagtgctgctgctcaacagtacatcagacaaggaagtcccacggcactgagagctgaattgtgggctctcattttgaatatttccagccaacctgaggatgtcttgtattatgagcagcttaagaccaatgtgatacaacatgaccttttggtggacagtctaatctataaagatg

SEQ ID NO: 189508 - DNA, 3046 bp, Homo sapiens
  Payload ID: 17420
  Gene Symbol: TBC1D2
  Gene Name: TBC1 domain family, member 2
  Uniprot ID: Q9BYX2
  ENST ID: ENST00000342112
  CDS Start-End: 562-2694
tggtggtcccgcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatcattca

SEQ ID NO: 189509 - DNA, 2100 bp, Homo sapiens
  Payload ID: 17420
  Gene Symbol: TBC1D2
  Gene Name: TBC1 domain family, member 2
  Uniprot ID: Q9BYX2
  ENST ID: ENST00000375063
  CDS Start-End: 339-1745
aactgcccagtaggttagttggtatttgccccttttacagatgaggaaacagagggtcagagtggttcagtggcctgcctgaggccttccagccagaacatcagccaggacttaaattcagacctactggtccctttaccacatcatgctgacatcaagaatagagaagggtgctatgagtattttatttttctttcagacttcctcttctgttgccattattggaaatttctaaggaaaagaagctttgggggctcatttgagggtgtgactccccaggaccagggagatgtttatgtccaactgataacatattttactctcttctccaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatcattcataa

SEQ ID NO: 189510 - DNA, 3174 bp, Homo sapiens
  Payload ID: 17420
  Gene Symbol: TBC1D2
  Gene Name: TBC1 domain family, member 2
  Uniprot ID: Q9BYX2
  ENST ID: ENST00000375064
  CDS Start-End: 40-2622
gcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaaggccgccaccaagcaagcgatgctgtactggctgcagcagctgcagatgaagcgctgggaattccacaacagcccgccggcacctcctgccacccctgatgccgccctggctgggaatgggcccgtcctgcacctcgagctagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccgctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatcattca

SEQ ID NO: 189511 - DNA, 3198 bp, Homo sapiens
  Payload ID: 17420
  Gene Symbol: TBC1D2
  Gene Name: TBC1 domain family, member 2
  Uniprot ID: Q9BYX2
  ENST ID: ENST00000375066
  CDS Start-End: 93-2846
ctccctttgggaagctgcccgccgagtctccgagatttgtccctggtggtcccgcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaaggccgccaccaagcaagcgatgctgtactggctgcagcagctgcagatgaagcgctgggaattccacaacagcccgccggcacctcctgccacccctgatgccgccctggctgggaatgggcccgtcctgcacctcgagctagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatcattca

SEQ ID NO: 189512 - DNA, 3349 bp, Homo sapiens
  Payload ID: 17420
  Gene Symbol: TBC1D2
  Gene Name: TBC1 domain family, member 2
  Uniprot ID: Q9BYX2
  ENST ID: ENST00000465784
  CDS Start-End: 181-2967
atctttgaggcgcgcgcaccgcacccggtcccgactctgtggcttcctgggggcgggttcgccgtcggccccgcccccgcccaggtgtctccctttgggaagctgcccgccgagtctccgagatttgtccctggtggtcccgcggacccctcgtccctccgcagtctccggctggcagcgatggagggcgctggggagaacgccccggagtccagctcctctgcccctgggtccgaagagtctgccagggatccacaggtgccgcctccggaggaagaatcgggggactgcgcccggtccctggaggcggtccccaagaaactctgtgggtatttaagtaagttcggcggcaaagggcccatccggggctggaaatcccgctggttcttctacgacgaaaggaaatgtcagctgtattactcgcggaccgctcaggatgccaatcccttggacagcatcgacctctccagtgcagtgtttgactgtaaggcggacgctgaggaggggatcttcgaaatcaagactcccagccgggttattaccctgaaggccgccaccaagcaagcgatgctgtactggctgcagcagctgcagatgaagcgctgggaattccacaacagcccgccggcacctcctgccacccctgatgccgccctggctgggaatgggcccgtcctgcacctcgagctagggcaagaagaggcagagctggaggagttcctgtgccctgtgaaaacaccccctgggctagtgggcgtggcagctgccttgcagcccttccctgcccttcagaatatttccctcaagcacctggggactgaaatacagaacacaatgcacaacatccgtggcaacaagcaggcccagggaacaggccatgaacctccaggggaagattctccacagagtggggagcctcagagggaggagcagcccttggcctctgacgccagcaccccagggagagagccagaggattctccaaagcctgcacccaagccttctctgaccatcagtttcgctcagaaagccaagcgccagaacaacaccttcccattcttttctgaaggaatcacacggaaccgaactgcccaggagaaagtggcagccttggagcaacaggttctgatgctcaccaaggagttaaagtctcagaaggagctagtgaagatcctgcacaaggcactggaggccgcccagcaggagaagcgggcgtccagcgcatacctggcggcggctgaggacaaggaccggctggagctggtgcggcacaaagtgcggcagatcgcggagctgggccggcgggtggaggccctggagcaggagcgggagagcctggcgcacacagcgagcctgcgggagcagcaggtgcaggagctacagcagcacgtgcagctgcttatggacaagaaccacgccaagcagcaggtcatctgcaagctctctgagaaggtcacccaggacttcacgcacccccctgaccagtctcctttgcgccccgacgctgccaacagggacttcctgagccagcaggggaagatagagcacctgaaggatgacatggaagcttaccggacccagaactgcttcctcaactccgagatccaccaggtcacaaagatctggagaaaggtggctgagaaggagaaggcccttctgacgaagtgcgcctacctccaagccagaaactgccaggtggaaagcaagtacctggccggtctgagaaggctgcaggaggccctgggggacgaagccagcgagtgctcagagctgctgaggcagcttgtccaggaggcactgcagtgggaagctggggaggcctcatctgacagcatcgagctgagccccatcagtaagtatgatgagtacggcttcctgacggtgcccgactatgaggtggaagacctgaagctgctggccaagatccaggcattggagtcacgatcccaccacctgctgggcctcgaggctgtggatcggccgctgagggagcgctgggctgccctgggcgatcttgtgccctcagccgagctcaagcagctactgcgggcaggagtaccccgtgaacaccggcctcgtgtctggaggtggctggtccacctccgtgtccagcacctgcacactccaggctgctaccaggaactgctgagccggggccaggcccgcgagcaccctgctgcccgccagattgagctggacctgaaccggaccttccccaacaacaaacacttcacctgccccacctccagcttccccgacaagctccgccgggtgctgctggccttctcctggcagaaccccaccatcggctactgccagggcctgaacaggctggcggccattgccctgctggtcctagaggaggaggagagcgccttctggtgcctggtggccattgtggagaccatcatgcccgctgattactactgcaacacgctgacggcatcccaggtggaccagcgggtgctccaggacctgctctcggagaagctgcccaggctgatggcccatctggggcagcaccacgtggatctctccctcgtcaccttcaactggttcctcgtggtctttgcggacagtctcattagcaacatcctccttcgggtctgggatgccttcctgtacgaggggacgaaggtggtgtttcgctatgccttggccattttcaagtacaacgagaaggagatcttgaggctacagaatggcctggaaatctaccagtacctgcgcttcttcaccaagaccatctccaacagccggaagctgatgaacatcgccttcaatgacatgaaccccttccgcatgaaacagctgcggcagctgcgcatggtccaccgggagcggctggaggctgagctgcgggagctggagcagcttaaggcagagtacctggagaggcgggcatcccggcgcagagctgtgtccgagggctgtgccagcgaggacgaggtggagggggaagcctgacttggccacctcccctccccacagccttcctcacccttggctggcagacccactggaggtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatggtggaaatcattcataagctttggaacttaaacagttctcagtt

SEQ ID NO: 189513 - DNA, 4466 bp, Homo sapiens
  Payload ID: 17421
  Gene Symbol: TBC1D20
  Gene Name: TBC1 domain family, member 20
  Uniprot ID: Q96BZ9
  ENST ID: ENST00000354200
  CDS Start-End: 149-1360
agcggggcgcctgcgcgcctgcgcgccgctggccgacggaggggagcctgccgatgccgagcgggtgctacgtcccgcggtcggagccgcgtcttctcccggctccgccaccagccggggctcgggtgggggcccggggccccggggcatggccctccggagtgcgcagggcgacggccccacctccggccactgggacggcggcgcggagaaggcagactttaacgccaaaaggaaaaagaaagtggcagagatacaccaggctctgaacagtgatcccactgatgtggctgcccttagacgcatggctatcagtgaaggagggctcctgactgatgagatcagacgaaaagtgtggcccaagctcctcaatgtcaatgccaatgacccacctcctatatcagggaagaacctacggcagatgagcaaggactaccaacaagtgttgctggacgtccggcggtcattgcggcggttccctcctggcatgccagaggaacagagagaagggctccaggaagaactgattgacatcatcctcctcatcttggagcgcaaccctcagctgcactactaccagggctaccatgacattgtggtcacatttctgctggtggtaggcgagaggctggcaacatccctggtagaaaaattatctacccaccacctcagggattttatggatccaacaatggacaacaccaagcatatattaaactatctgatgcccatcattgaccaggtgaatccagagctccatgacttcatgcagagtgctgaggtagggaccatctttgccctcagctggctcatcacctggtttgggcatgtcctgtctgacttcaggcacgtcgtgcggttatatgacttcttcctggcctgccacccactgatgccgatttactttgcagccgtgattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggtctcacccttccatggaaggattgggaggggtggaatttcctttattaaaagggtttctgtccagagttttttattcctgccaccctgccctgcccgtttgtgtttgcctttacttcagaggccagtagcagagcctacctgacacagaggggacctgggggcctggcacagaatcttatgcctctcccagtgggcttttggatgggctctctgccacctccctggtgttggaggaagtgggtttctgaagcttgcagctgcttttgcaacctgctgggcctgggctgccctagttaccgggaacctcctagtcaccccatagaaggtgaactggaacatgggatgccctcttactgctcctgcttgcctgcatcagatggacacagaaggagggggctgctgctgaaggagtcaggcttgggatggagagcaagaggccaaaggactcgtctgggagcatgatcggcccctcttactagcagctccatcagctgatcagaaatcagagacagaagggaactaggttactcgttaaatcctacctattttcagcctagaaatcacatgggcgtttccagtcaagtgggaaggaagctcatttttagggcctagacctagactagttttgcctgcctttttttcctccctgctttcttctacaagccacacaacattgcttataaaaggtacttttattactatttttagaatatatacaccccatatgtaaattaccctcacttttaaagtaataatagttccttcacggaaaaaaaaatagttctcatcagaaggatgagcttctaagatcctgaattttactttctacttgattaacattttcgctttagccagagttgctatttgcaaacagctttccacttccaaagtgccactttctgaccggtttttcttcctgttttcctcaaatcatcctactcccaaataggcacccactcactaccttggcgtcgttttttgggtctgacttgactcgtcaactgctggtctctcccacctggttggaaatgtcgttggaaacttgcaaagactctccagaccttagggaacaagaggcatcactcagtccttctgggacagcttccctgtaagcaaagccaggtttgttttagattcactctggcctgaaaaaaaaagtgccttttgctgctttaaagaattggggtatatggtatgaagcagccatgtacttgtattttcctggtctttcctgggcactcttctctcttggcagatgttttcttaaagtgaacacaccagaagcactctaccccaccatatccagtcctctttgcatgcctgttgtgtgcagggtggagggtgtcccacgtgccagagcagctgggagccctgtccgctgagttacactaagcactttatttttatttattttattattattttcttttttctgagatggagtctcactctgttgcccaggctggagtgcagtggtgcagtctcagctcactgcaacctccgcctcccaagttcaggcaattctcgctgcctcagcctcccgagtagctgggactacaggcacctgctaccacgcctgactaatttttgtatttttagtagagatggggtttcgccacgttggccaggctggtctcgaactcctgacctcaggtgatctgcccgtctcgtcctcccaaagtgctgggattacaggtgtgagccaccacgcccagccaccactacgcactttaaaaccaaaaaaagctcaaagggatggatcattgtccatggctcaggagccccactgtggggtaagtgtgatgtcgatggattaatttagacagtggtgtattcatcagggcaaaggaaattcttccagaggtgatgatgcggcagatattcccagtgctctcccaaagcaagctggccctcttgtcatcctctcagtgggcggcaccagctgcccctccttccacaagtactcaagcctgtttgtaaatactgaaggaattgatggggttgaggaaaggaggtgcatgtgaccagggtcccaaggccacagcttttcagatcctaggaagcaagtggcatttgcttgagttgtggcctcggaaggagaatgtttatctgttttctaactttgctgacaccaggattctccctgtcattgagaagaaagcattatctaattaccttcaggtggtttacttattctgtaaagaatatgtgtaaatattttgtacagagccctgtatcaaataaacagccatatgtggttactaatcacctcttctgtcattccgtccttggccaccgctcagtgggaatggtctctgatctggatgctcccaccttccatgtcaggcccagaactgtgccatggtctgtggactcctggtcagccttgactggctaggagaccttgggcagtacctacagtcttgctgtttctgtttcatctgcaagaattatgacccacacactccagctgcagcccagggcactgtgatattttatacgtgtgtagatgtttttgtccacagttcctggttcatcactcccataaccctttgttataatgttgggacactgcaggcctcagaaaacggaatctctgtctgtgaccttctcctgccccatttcacttgctcaacaccagactttaatctgactgtagctcataagaccctcattccagagagggtgctgccccatacccggaaggaggaacgctgcacagagaggccaagaagcatctggacagacaggccttgctgggtttagaccttatgctttttgtccagtttcatctcaacacagctgccatgcttcagccatgcctatccaatgacgtctccataaaaggcccaggaacacgggagcttctgaagagctgaacatgtggagggaggggaacgagaacttgtccatgtgccaagagggtggcgcacccccactccatggggacagaagctccagcatttgcccaggacccgtccagacctcaccctgtgtgtatcttcatctggctgtttacttatttgtatccttttctaataatgtttgtaataaactggtaaacataa

SEQ ID NO: 189514 - DNA, 2024 bp, Homo sapiens
  Payload ID: 17421
  Gene Symbol: TBC1D20
  Gene Name: TBC1 domain family, member 20
  Uniprot ID: Q96BZ9
  ENST ID: ENST00000461304
  CDS Start-End: 127-1338
gcgccgctggccgacggaggggagcctgccgatgccgagcgggtgctacgtcccgcggtcggagccgcgtcttctcccggctccgccaccagccggggctcgggtgggggcccggggccccggggcatggccctccggagtgcgcagggcgacggccccacctccggccactgggacggcggcgcggagaaggcagactttaacgccaaaaggaaaaagaaagtggcagagatacaccaggctctgaacagtgatcccactgatgtggctgcccttagacgcatggctatcagtgaaggagggctcctgactgatgagatcagacgaaaagtgtggcccaagctcctcaatgtcaatgccaatgacccacctcctatatcagggaagaacctacggcagatgagcaaggactaccaacaagtgttgctggacgtccggcggtcattgcggcggttccctcctggcatgccagaggaacagagagaagggctccaggaagaactgattgacatcatcctcctcatcttggagcgcaaccctcagctgcactactaccagggctaccatgacattgtggtcacatttctgctggtggtaggcgagaggctggcaacatccctggtagaaaaattatctacccaccacctcagggattttatggatccaacaatggacaacaccaagcatatattaaactatctgatgcccatcattgaccaggtgaatccagagctccatgacttcatgcagagtgctgaggtagggaccatctttgccctcagctggctcatcacctggtttgggcatgtcctgtctgacttcaggcacgtcgtgcggttatatgacttcttcctggcctgccacccactgatgccgatttactttgcagccgtgattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggcacccactcactaccttggcgtcgttttttgggtctgacttgactcgtcaactgctggtctctcccacctggttggaaatgtcgttggaaacttgcaaagactctccagaccttagggaacaagaggcatcactcagtccttctgggacagcttccctgcctcagaaaacggaatctctgtctgtgaccttctcctgccccatttcacttgctcaacaccagactttaatctgactgtagctcataagaccctcattccagagagggtgctgccccatacccggaaggaggaacgctgcacagagaggccaagaagcatctggacagacaggccttgctgggtttagaccttatgctttttgtccagtttcatctcaacacagctgccatgcttcagccatgcctatccaatgacgtctccataaaaggcccaggaacacgggagcttctgaagagctgaacatgtggagggaggggaacgagaacttgtccatgtgccaagagggtggcgcacccccactccatggggacagaagctccagcatttgcccaggacccgtccagacctcaccctgtgtgtatcttcatctggctgtttacttatttgtatccttttctaataatgtttgtaataaactggtaaacataa

SEQ ID NO: 189515 - DNA, 1207 bp, Homo sapiens
  Payload ID: 17422
  Gene Symbol: TBC1D21
  Gene Name: TBC1 domain family, member 21
  Uniprot ID: Q8IYX1
  ENST ID: ENST00000300504
  CDS Start-End: 84-1094
caacccatctccgaaaaggattaagcatcactagggctccaagtgagttctgatcagaggctgttcggaagacagcaggggccatgaccaccctctctcctgaaaacagcctctctgccagacagtcagcctccttcatcctggtgaagagaaaaccacccattgacaagacagaatgggacagcttctttgatgagagtggccacttggccaaatcacgggacttcatttgtgttaacatcctggaaaggggtctgcaccccttcgtgaggactgaagcctggaaattcctcacgggctacttctcatggcagagttcccaggatgagcggctcacggtggacagcatgaggaggaagaactacaaggccttatgccaaatgtatgagaagattcagccccttctggaaaacctgcaccggaacttcacagagactcgcaataacattgcacgtgacattcagaaaatctatgacaaagatcccctgggcaacgtcctcatcgacaagaagaggctagagaagatcctgctcctgagttacgtctgcaacacgcaggcagagtaccagcagggcttccatgagatgatgatgctcttccagctgatggtggagcacgaccacgagaccttctggcttttccagttcttcctgcagaaaacggaacacagctgtgtcatcaacattggcgtggccaagaacctagacatgctcagcaccctgatcaccttcctggaccccgtgtttgctgagcacctaaaagggaagggtgcaggggctgtgcagtccctcttcccctggttctgcttctgcttccagcgtgccttcaagtccttcgatgatgtctggaggctctgggaggttctgctgacggggaagccctgcaggaacttccaggtgctggtggcctacagcatgctgcagatggtgcgggagcaggtgctgcaggaaagcatgggcggggatgacatcctcctggcctgcaacaacctcatcgaccttgatgctgatgagctgatctctgccgcctgcgtggtttatgctgagctcatccagaaggatgttcctcagacattaaaggatttcttcctctgaggacaccaaagcccgcagtggactgatgccttcgatgggcaggatgaaggccaggggcactggagtgagggagtagataaaacagctgcaatataaacagtcctctggaataa

SEQ ID NO: 189516 - DNA, 1005 bp, Homo sapiens
  Payload ID: 17422
  Gene Symbol: TBC1D21
  Gene Name: TBC1 domain family, member 21
  Uniprot ID: Q8IYX1
  ENST ID: ENST00000535547
  CDS Start-End: 103-1005
ccagttcctcctgggaatgcaacccatctccgaaaaggattaagcatcactagggctccaagtgagttctgatcagaggctgttcggaagacagcaggggccatgaccaccctctctcctgaaaacagcctctctgccagacagtcagcctccttcatcctgggtctgcaccccttcgtgaggactgaagcctggaaattcctcacgggctacttctcatggcagagttcccaggatgagcggctcacggtggacagcatgaggaggaagaactacaaggccttatgccaaatgtatgagaagattcagccccttctggaaaacctgcaccggaacttcacagagactcgcaataacattgcacgtgacattcagaaaatctatgacaaagatcccctgggcaacgtcctcatcgacaagaagaggctagagaagatcctgctcctgagttacgtctgcaacacgcaggcagagtaccagcagggcttccatgagatgatgatgctcttccagctgatggtggagcacgaccacgagaccttctggcttttccagttcttcctgcagaaaacggaacacagctgtgtcatcaacattggcgtggccaagaacctagacatgctcagcaccctgatcaccttcctggaccccgtgtttgctgagcacctaaaagggaagggtgcaggggctgtgcagtccctcttcccctggttctgcttctgcttccagcgtgccttcaagtccttcgatgatgtctggaggctctgggaggttctgctgacggggaagccctgcaggaacttccaggtgctggtggcctacagcatgctgcagatggtgcgggagcaggtgctgcaggaaagcatgggcggggatgacatcctcctggcctgcaacaacctcatcgaccttgatgctgatgagctgatctctgccgcctgcgtggtttatgctgagctcatccagaaggatgttcctcagacattaaaggatttcttcctctga

SEQ ID NO: 189517 - DNA, 965 bp, Homo sapiens
  Payload ID: 17422
  Gene Symbol: TBC1D21
  Gene Name: TBC1 domain family, member 21
  ENST ID: ENST00000562056
  CDS Start-End: 65-964
attaagcatcactagggctccaagtgagttctgatcagaggctgttcggaagacagcaggggccatgaccaccctctctcctgaaaacagcctctctgccagacagtcagcctccttcatcctggtgaagagaaaaccacccattgacaagacagaatgggacagcttctttgatgagagtggccacttggccaaatcacgggacttcatttgtgttaacatcctggaaaggggtctgcaccccttcgtgaggactgaagcctggaaattcctcacgggctacttctcatggcagagttcccaggatgagcggctcacggtggacagcatgaggaggaagaactacaaggccttatgccaaatgtatgagaagattcagccccttctggaaaacctgcaccggaacttcacagagactcgcaataacattgagtaccagcagggcttccatgagatgatgatgctcttccagctgatggtggagcacgaccacgagaccttctggcttttccagttcttcctgcagaaaacggaacacagctgtgtcatcaacattggcgtggccaagaacctagacatgctcagcaccctgatcaccttcctggaccccgtgtttgctgagcacctaaaagggaagggtgcaggggctgtgcagtccctcttcccctggttctgcttctgcttccagcgtgccttcaagtccttcgatgatgtctggaggctctgggaggttctgctgacggggaagccctgcaggaacttccaggtgctggtggcctacagcatgctgcagatggtgcgggagcaggtgctgcaggaaagcatgggcggggatgacatcctcctggcctgcaacaacctcatcgaccttgatgctgatgagctgatctctgccgcctgcgtggtttatgctgagctcatccagaaggatgttcctcagacattaaaggatttcttcctctgag

SEQ ID NO: 189518 - DNA, 3787 bp, Homo sapiens
  Payload ID: 17423
  Gene Symbol: TBC1D22A
  Gene Name: TBC1 domain family, member 22A
  Uniprot ID: Q8WUA7
  ENST ID: ENST00000337137
  CDS Start-End: 167-1720
gcgcgtaggcacaacttccggaaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcgtgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccatggaccggttcctccgtggaccggttccgccatggaccggttccgccatggaccactcctgccctggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctccagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaa

SEQ ID NO: 189519 - DNA, 1886 bp, Homo sapiens
  Payload ID: 17423
  Gene Symbol: TBC1D22A
  Gene Name: TBC1 domain family, member 22A
  Uniprot ID: Q8WUA7
  ENST ID: ENST00000355704
  CDS Start-End: 107-1426
cccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagtttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcgtgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatct

SEQ ID NO: 189520 - DNA, 3934 bp, Homo sapiens
  Payload ID: 17423
  Gene Symbol: TBC1D22A
  Gene Name: TBC1 domain family, member 22A
  ENST ID: ENST00000380995
  CDS Start-End: 398-1861
gggcgcgcgtaggcacaacttccggaaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcacgcattcctcagggaggagactggtttctcattcagccacactgatcaagcagtcgctttgtgtgagatactgtgcaccccgtgctgcgcatcccggtgaagacggcggatgtgggagccacagcctgatgtggggagtttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcgtgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccgagacgttgcgctgacccggggtctctgtgccgcgaggtcccctcacagctgtatttcactgctgctggccctttccctccgtgtgttttcctgcttgcttggtttaaacgtggctgggaagctgaaggctggagtccaagccgtgagcccgccgagtgcctgggaggccgtgggaccaaaggctgggagcagagggaggcctcgccatcgccttactttccaccttgaacctcttttacaagagagaaacccccacctccctgaggtccagggccaagtggccccgccacgcaggtaggcgccggcctcagccagagcccctggaggcccacccaggctgtcgggccatgttgggctggcagacgggcagggggtcgcgtccctgtcatcaaagccctgaaccacagtgctcttctcaccgcagcctggaagcggaatgagcttttggagacttcctgggacttgctgtccttgtccaggtctgccaggtgtaggggaggtgtgactggttccatcatggaccggttcctccatggaccggttcctccgtggaccggttccgccatggaccggttccgccatggaccactcctgccctggaccactcctgccctggaccggttctgccgtggactggttcccgccgtggaccagttcccgctgtatactggttctgccctggactggttcccgctgtggactggttccttggggctctaagtgcggaagggcccagagctggtccctgcccagcgccctgctagggctgtgtccttggctccaggggccttgggactggcttcccagcgttccctcggtgtgtcacaggctgcatgacccctggaatgcgggcagggccacagccacagtctgtctgatccctgagcccaggacaggctcacgtcctcagcgacccactggtgactgacttcccagactctcctctgtccctcaggagcagccgtgtcctctcccaggccctaggacactgccagagactgtgggacatacaggcataagtgatgtgtgtgtttctgcttctgttttaaaaatccagggtcattacacacagcatggaaattagcacaaaatgctgtgcaaacgtcagatgctcccaaaccagcaaagggatgggcttgcttcacatcagatgcgggcacgccttacccctgccttccgtgtccccaccccagggtcaagggttcctcagaccagccatgcctcctcctcctgccgcctccttttctagatggggaggggattccgtcacaagaagagccgcccctcggccgtgtgcaggaagccccatgtcgctttgccgagatcagccctgggaggatccccttctccagctcagatcatgccgtgtggccagaaggctgcggacacaactgacctgcttctcgaggtggttgatgttttaaacaggaagctccacggagttcagccctgtgtgcatttcctcatgtatgtaaacgccaagactgaatgtgagaggtgttggccgcgggccttaagtctgagcagatccatctggaatgttcggggtgtgctgtctggatgtggtgcgctaaaaacacggaataaagatcagtgacaaagccgcg

SEQ ID NO: 189521 - DNA, 2048 bp, Homo sapiens
  Payload ID: 17423
  Gene Symbol: TBC1D22A
  Gene Name: TBC1 domain family, member 22A
  ENST ID: ENST00000394449
  CDS Start-End: 105-818
cgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcgtgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatcta

SEQ ID NO: 189522 - DNA, 1949 bp, Homo sapiens
  Payload ID: 17423
  Gene Symbol: TBC1D22A
  Gene Name: TBC1 domain family, member 22A
  ENST ID: ENST00000407381
  CDS Start-End: 116-1492
ctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcgtgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaa

SEQ ID NO: 189523 - DNA, 2267 bp, Homo sapiens
  Payload ID: 17423
  Gene Symbol: TBC1D22A
  Gene Name: TBC1 domain family, member 22A
  Uniprot ID: Q8WUA7
  ENST ID: ENST00000406733
  CDS Start-End: 389-1801
agaagtctgtgcccttacccatcacagcctcatccttatctcctccattccctaggggacttaacaggtgttgaaattattacagagaaagctgactcactcaccaggaatctgatcctgctgtgggctggcttgggtggaggtgttcctcccgcccccgcacccatcctcctgtttgaactcaggctgctgcctgctgggcctgcctgcccttggagccctgctgagctcagcctgaggcctggctcctccaggctgggggaaaaccaggcttgctgtgctcggcagcagagattcttctggagtgagcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagaggcagaggaggtggacacggtggacgtctccggcgtgcccgcagaggtgctgtgcaacatcgaggccgacacctactggtgcatgagcaagctgctggatggcattcaggacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcgtgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccg

SEQ ID NO: 189524 - DNA, 590 bp, Homo sapiens
  Payload ID: 17423
  Gene Symbol: TBC1D22A
  Gene Name: TBC1 domain family, member 22A
  ENST ID: ENST00000441936
  CDS Start-End: 137-313
gaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagagacggggtttcactgtgttatccaggatggtctcgatctcctgacctcgtgatccgcccgcctcggcctcccgataagactgggtttctgtgctcctgtgacatgctcttgtaggaatcatcatagaacagtcaaaatgccagttgaagttttgcttttcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggcc

SEQ ID NO: 189525 - DNA, 2636 bp, Homo sapiens
  Payload ID: 17423
  Gene Symbol: TBC1D22A
  Gene Name: TBC1 domain family, member 22A
  Uniprot ID: Q8WUA7
  ENST ID: ENST00000441162
  CDS Start-End: 755-1729
aatattattgtttgagtgtttgaatgataaactttggaatttactgcatccagttagaaaagtttacttttggccaggtgtggcggctcacgcctgtaatcccagcactttgggaggtcgaggtggacagatcacctgaggtcaggagtttgagaccagcctcaccaacatggagaaacctagtctctactaaaaatacaaaattagctgggcatggtggcacatgcctgtaatcctggctacttgggaggctgaggcaggagaatcacttgaacctgggaggtggaggttgcagtgagccgagatcgttccattgcactccatcctgggcaataagagcgaaactctgtctcaaaaaaaaaaaggaaagtttacttttaagagtgatctgggggttagcagcgtgagttactgacagctcagacagtggctttgagaatgaagggagtcatcaaaggtggccggagaccctattcgactccacaggaccgtgcttgattcgagaacagtaagacctttcaacaaaaccagtgtcagggtccaagattggaggcgttgggagtcggggcaagggcagaagcagggagaccaggaggccagggtgccgcagcgtccagtggtcactggtggtggcggcttgcacctgagtggaagctgtggtggtggcaagaaatgcatccagcacgtgtatggtgcccagcaccccccctttgatccactgttacatggcactttgctcaggtccacggccaagatgccgaccacaccagtgaaggccaagagggtcagcaccttccaggagtttgagagcaataccagcgatgcctgggacgctggggaggacgacgatgagctcctggccatggcggcggagagcctgaactccgaggtggtcatggagacggccaaccgtgtgctgcgtaaccacagccagcggcaggggcggcccacgctgcaggaggggccagggcttcagcagaagcccaggcccgaggcagagccgccctcaccccccagcggcgacctccggctggtgaagtcggtcagtgagagccacacgtcctgtcctgcagaaagtgccagcgatgccgcccctctgcagaggtcccagtctctcccacactcggccaccgtcacgctgggtggcacatctgaccccagcactctcagcagctcagcgctgagcgaaagagaggcctcccggctcgacaagttcaagcagctgcttgccggccccaacacggaccttgaggaattacggaggttgagctggtccggaatccctaagccagtgcgtccaatgacgtggaagctcctctcaggttaccttcccgccaatgtagaccggagaccagccactctccagagaaaacaaaaagaatattttgcatttattgagcactattacgattctaggaacgacgaagttcaccaggacacatacaggcagatccacatagacatccctcgcatgagccctgaagcgttgatcctgcagcccaaggtgacggagatttttgaaaggatcttgttcatatgggcgatccgccacccagccagtggatacgttcagggtataaatgatctcgtcactcctttctttgtggtcttcatttgtgaatacatagcctttccaggttgtggtcggcctcagattcccatccttgctgtgatctggagagatgagccttacccgaggacagatgaacagattatcctcagaagatgaggacatatccaagacaactacacctttgcccaacctgggattcaaatgaaagtgaaaatgttagaagaactcgtgagccggattgatgagcaagtgcaccggcacctggaccaacacgaagtgagatacctgcagtttgccttccgctggatgaacaacctgctgatgagggaggtgcccctgcgttgtaccatccgcctgtgggacacctaccagtctgaaccggacggcttttctcatttccacttgtacgtgtgcgctgcttttctcgtgagatggaggaaggaaatactagaagaaaaagattttcaagagctgctgctcttcctccagaacctgcccacagcccactgggatgatgaggacatcagcctgttgctggccgaggcctaccgcctcaagtttgcttttgccgacgcccccaatcactacaagaaatgagcccaggcccacccgcagctggcctcactgtcccgggtggcgcgccccacctgcctggctggtggtaggcccctgtgagctggtcccgggctgctaaaaggccttgtgaggtggccccaccctccaggggagctggtgaagatgggccacagacctggtctagggctgacaaagacagggacagcctttgttttctgagataccaaagagagccaggggagggccccgggttcggcggccagaggcaggtcaggggtcccctctccctctccctgcaatgtccttgccaaatgactgcctcgtgctgcccctagtccggggcagcctaggaggccgaccctctttggagtcctgctgtctgggtgccagggccggaacgaggtagtggccatctcatacctactctgaaatgcaaaacttctattctgttgagtgaaagaataaaatgtagacaaaatctagaccg

SEQ ID NO: 189526 - DNA, 3462 bp, Homo sapiens
  Payload ID: 17424
  Gene Symbol: TBC1D22B
  Gene Name: TBC1 domain family, member 22B
  Uniprot ID: Q9NU19
  ENST ID: ENST00000373491
  CDS Start-End: 147-1664
acatccaagatggcgtccccaggagctgggagcgggtgaccggcggcggggaagcggcctgggttggccctcagattgcggggtctgggggcatctcgccgggcaaacccttggcccgcctacaaggacttcccccggccagagcaatggccgctgagaacagcaagcagttttggaagaggagcgctaagctgccggggagcattcagcctgtatatggagcacagcatcctcctcttgacccacggctcaccaaaaatttcattaaagaacgatcaaaagtcaacacagttcctctgaagaataagaaggcctccagttttcatgagtttgcacggaataccagtgatgcttgggacattggcgatgatgaggaagaggacttttcctcaccttctttccaaactctgaactcaaaagttgctttggcaactgcagcccaagttctagaaaaccacagcaagctgagagtaaaaccagaacggtcccagtcaacgacatcggacgtccctgccaactacaaggtcataaagtccagcagtgatgcccagctgtccagaaactctagtgatacatgcctgaggaacccactccacaaacagcaatcactccctctccggcccatcatccccctcgttgcccggatctcggatcagaacgcttctggggcccccccaatgactgtccgggagaaaacccgcctagaaaaattccgtcaacttctctccagccagaacactgacttagatgaactgaggaagtgtagctggccaggggttcccagggaggttcgacctataacctggagactcctgtcgggctatctcccagcaaacactgagaggaggaagttgaccctgcagcggaagcgggaggaatattttggcttcattgaacagtattatgactctcgaaacgaggaacatcaccaggatacctacagacagattcacattgacattccaaggacgaatcctctcattccgttgttccagcaaccacttgtacaggagatctttgaaagaattctatttatttgggccatccgccaccctgccagtgggtatgtccagggaattaatgacctggtcactccattctttgtcgtcttcctctcagaatatgtggaagaggatgtggagaactttgacgtgaccaacttgtctcaagacatgctgcgaagcattgaggctgacagcttttggtgcatgagcaagctgctggatggaatccaggataactacacctttgcacaaccaggaatccagaagaaggtgaaggcactggaagagcttgtcagccggattgatgagcaggtacataatcacttcaggaggtacgaggtagaatacctgcagtttgccttccgctggatgaacaacctgcttatgcgggagcttcctcttcgctgcaccatccgcctgtgggacacatatcagtctgaaccagaagggttctcccactttcatctctacgtgtgtgcagccttcttgatcaagtggaggaaagagatcttggatgaggaggattttcagggtctcctcatgctgctacagaacctacctacaatacactggggcaacgaagaaattgggctgcttctcgccgaggcatacagactcaagtacatgtttgccgatgccccaaatcactaccgccgataggtgctgtctcctccggggacccagactgccttcatctctgatggcagtctgatcactgtggccactgtgcgagccgtggaccccggccaggaaccactcctgttgtacaaagctcacacccaccgcccaggtcttaactttctggcatccaccactccatgtctctggatgtgtcacttggaccactgtcagtattccatgccgcgtggatgggcccagttctgggagaggacagaaaaggtggtacagggttgtctgcccctttaaaagaaactggacaaagaaggggaaggctcagggtctcacctcacattgtccctacaaggacaggccccaactgataaccgttgcttttttttttttgtgaacatagtttgatttgatcacaggtcaaaaacgccttatattttcgaaagactcctggcccctcttccctcttcctggtttcctagccgttccccttctgccccagtctgagccagtgaggggtagctttttaaaaccattattctagatggaggaggcactgatgcttgtaactctggaaagaggcctacacccaagggctaggaattttatttttccttttctcaccaggtgtctgcatgtgtgtgtgggtgtgaatgtgtatacatgcccatcagcatttagtcacatgtctgaatttctgtgtccagacgagccccatcaaactagttgggaagggccccagtgaccaagtgtataagcatcccttgaagagggattggggcaggggaggcagaaggggctctccagaccccttttccatgatgacccactccaagatattatgtgtaaattgtgttattatgtatatgggtaaagatgtacaaatatatgtcctctttgtagcagatatgattttatatttataatgtgcatcaacatgtgaaagcaatctaggtcactagcacagaggaagttgccaggaaggtggcttcagcacctccaggttggttctgggtgtcctgctgtgaggggtagaacgggaggctgctgaagtgagtagctgagcagctggagccatcccaagcatcagtgtctcagagtcctcctcgcccctttcttcaccccgccccccaacccccagactttcctggagcatctgccctttgctcctagcagcctccccaggaagggactgcagaggcgggcaagccctctctatgtgtttttatccccaccttccccggaatctggggagggcttttgtttttacgttttcaagttcagcattgtattcggacagaagctgtgactgaagactcagtgccaaggaaaggggcttcttgtgtgtccctcgggtttggggctcttctcagagagcagcactccatatcccttactgtcaccttcactccccacacagctcatgagatgtgtgacccctgtttgagttttggtatttggtagtggagggtggggggatgggggccagcagctgtcatcctcctgggaagccgagcagtgtccctggtgggtaacaccctcaagtctctttgccagtgaggccccaccacatcggtgtgagttaggtttctcatctggagctgtttctcaggcattcttcccaaccctcttccttttccccttcggtgtgcctcagtggtctccttcatagagtgagagggcttgagaccctccctcaaccggactaattaaagaaagacacttgtgttcccaagtggtggttttatttttttagtttttatgtttgtatgggaaattgtggataaagtgaaaagaattgtaaataaatggtgtatttcctcctcca

SEQ ID NO: 189527 - DNA, 3656 bp, Homo sapiens
  Payload ID: 17425
  Gene Symbol: TBC1D23
  Gene Name: TBC1 domain family, member 23
  Uniprot ID: Q9NUY8
  ENST ID: ENST00000344949
  CDS Start-End: 19-2073
acgtggacgtcaacagcaatggcggaaggagaagatgtgccgccgctgccaacgtcgagcggcgacggctgggaaaaagatcttgaagaagctctggaagcaggaggttgtgatcttgaaacgttgagaaatataattcaaggaagaccgctgcctgctgatctgagggccaaagtttggaagattgctctgaatgttgcaggaaaaggtgatagtttggcatcatgggatggtattttagacttgccagaacagaacactattcacaaagattgcctgcagtttattgaccagctttcagtgccagaggagaaggcagcagaattacttttggatattgaatctgtaattaccttttattgtaaatcacgtaacattaaatatagcacatcccttagctggatacatctactgaaaccattggtgcatcttcaactgccacgcagcgatttatacaactgcttttatgccataatgaataagtacattcccagggattgttcccagaaagggagaccatttcatctcttcaggttgctcatccaataccatgagcctgagctttgttcttatcttgatacaaagaaaattactccagactcctatgcactcaactggcttggaagtctttttgcatgttactgttccactgaagtcactcaggcaatatgggatggatatctacaacaagcagatccattttttatttatttcttaatgttaattatccttgttaatgcaaaagaagttattttaacacaagagtcagacagcaaagaagaagttatcaagttcttggaaaatactccatccagtctgaatatagaagatatagaagaccttttctctctggctcagtattattgcagcaaaacaccggcttcttttaggaaggataatcaccatctctttggtagtactttgttgggaattaaggatgatgatgcagatctgagtcaggctctttgtctggccatctccgtgtcagagatccttcaagcgaatcagctacaaggggaaggagtccggttctttgtggtggattgccgtcctgcagaacaatataatgctgggcatttatcaactgctttccacttagattcagacctgatgcttcagaatccatctgagtttgcacagtcagtaaaatccttgctggaagcacagaagcagtccattgagtctggctccatagctggtggggagcacctctgttttatgggcagtggcagggaggaagaagacatgtatatgaacatggtcctggcacactttttacagaaaaacaaagaatatgtgagtattgccagtggaggatttatggcactgcagcagcacctggcagacattaatgtggatggaccagaaaatggatatggccattggattgctagtacctcaggctcaaggagcagtatcaattctgttgatggtgaatctcctaatggctcaagtgatagaggaatgaaatcactagtaaataaaatgactgtggctttgaagacaaaatccgttaatgtcagggaaaaagttatcagttttatagagaatacatcaactcctgtggatcggcatgtgagcagcagtgacagagtgggcaagccttaccgtggcgtaaagcctgttttcagcattggggatgaagaagaatacgacacagatgaaattgacagttcttcaatgtcagatgatgatagaaaagaggttgtaaacattcagacttggataaacaaaccagatgtcaaacatcattttccttgtaaagaagtaaaagaaagtggacacatgtttcccagtcatctgttggttactgcaacacatatgtactgtttaagggagattgtttcacggaaaggattggcttatatacagtctcgacaagcgctgaattctgtagttaaaattacatccaaaaaaaaacatcctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaagaaattaagacaaccaagagaaacatggacatatacctcctgactgaatactaactggagacctttcatttgctcatggggctgcttaaatagcaggtctaagaaagtgtaaattattataatcaatctgtggacagtaaactttttaaaaatttttcttctgcattttggttttataaaatgatgtattataaaggtcagttattaaattactttgaagtaactgaccctgtgcccttatggactaagtaagggtacagaatgcagttctgttttgaagagctgttttaagggaacatgcatcactttcgggatcaaaaacaactgtacacatacatatctgcagtgtcttcactgaaaattagagatagaattagttgaagagacttccttaattgctacattgttttactcactgagcaatatcagaaactaaaacatagattaataattcactcactgtttctattcttcttaaaaagagtgaaatctttttaatggaatggttgaagattcctgccaactcaaaatacagtacagctagtaaaatgttgaaacatcagtttctaaatcacctttgctccattagctaattttttggacactaaatgcttcaaagataagaaacttcatcctaatgatttctaaagagcagttaaaagcattaaaataagtaggtaggctgttaagattaaaattaacattttggggacagaattgtgtctgtaaaaatgtcattggttttattacaagcggattattttattcatattttaaaacaaatgtttaagccacattgatttatcctcattgaggattatggtctgtgaccacagtaatatccacttatataaatgccaaataatcagagagcttataaagtacaattgtttttgtcatcattttctgaatttctttctcttcttttggttttgtcctctcattgaagttccagtggtttgaaattagttttggacacattgtcttaatgtactgaaaattgctctgctgtattttgcagcgttcttcatttaatttataatggtccatattagacacatttggtaagagaagtccaggaacacatttagggccatggaatagtattttgtaaaatccatttgggaagttgcaatacccacaatctgacatgtcctaaaatgtaagggattatctctaaggggttgatgggagaaatatttagatgtaccctgttaacagccagtcattttgatttacttatggaaatcaagtgaataaaaggcaacataatttgggaaattttattctaatatctaataaaaacagtttgagtggttgaagacatctgcatgaaattgcacctaggtgcattacttgatataactctcccctaaaactgttgtaattgcattttttcccttttcttggcacccctttagaaatgtactgaagtctcatttttcacccatttcagccatgggacatttttcataatattaatgtaaagatgtttgtgttactgtttataaattacaattgtaaataaattactagtttgcccaaaactttgttcttaaa

SEQ ID NO: 189528 - DNA, 3677 bp, Homo sapiens
  Payload ID: 17425
  Gene Symbol: TBC1D23
  Gene Name: TBC1 domain family, member 23
  Uniprot ID: Q9NUY8
  ENST ID: ENST00000394144
  CDS Start-End: 8-2107
aacagcaatggcggaaggagaagatgtgccgccgctgccaacgtcgagcggcgacggctgggaaaaagatcttgaagaagctctggaagcaggaggttgtgatcttgaaacgttgagaaatataattcaaggaagaccgctgcctgctgatctgagggccaaagtttggaagattgctctgaatgttgcaggaaaaggtgatagtttggcatcatgggatggtattttagacttgccagaacagaacactattcacaaagattgcctgcagtttattgaccagctttcagtgccagaggagaaggcagcagaattacttttggatattgaatctgtaattaccttttattgtaaatcacgtaacattaaatatagcacatcccttagctggatacatctactgaaaccattggtgcatcttcaactgccacgcagcgatttatacaactgcttttatgccataatgaataagtacattcccagggattgttcccagaaagggagaccatttcatctcttcaggttgctcatccaataccatgagcctgagctttgttcttatcttgatacaaagaaaattactccagactcctatgcactcaactggcttggaagtctttttgcatgttactgttccactgaagtcactcaggcaatatgggatggatatctacaacaagcagatccattttttatttatttcttaatgttaattatccttgttaatgcaaaagaagttattttaacacaagagtcagacagcaaagaagaagttatcaagttcttggaaaatactccatccagtctgaatatagaagatatagaagaccttttctctctggctcagtattattgcagcaaaacaccggcttcttttaggaaggataatcaccatctctttggtagtactttgttgggaattaaggatgatgatgcagatctgagtcaggctctttgtctggccatctccgtgtcagagatccttcaagcgaatcagctacaaggggaaggagtccggttctttgtggtggattgccgtcctgcagaacaatataatgctgggcatttatcaactgctttccacttagattcagacctgatgcttcagaatccatctgagtttgcacagtcagtaaaatccttgctggaagcacagaagcagtccattgagtctggctccatagctggtggggagcacctctgttttatgggcagtggcagggaggaagaagacatgtatatgaacatggtcctggcacactttttacagaaaaacaaagaatatgtgagtattgccagtggaggatttatggcactgcagcagcacctggcagacattaatgtggatggaccagaaaatggatatggccattggattgctagtacctcaggctcaaggagcagtatcaattctgttgatggtgaatctcctaatggctcaagtgatagaggaatgaaatcactagtaaataaaatgactgtggctttgaagacaaaatccgttaatgtcagggaaaaagttatcagttttatagagaatacatcaactcctgtggatcgaatgtctttcaatcttccttggccagacagatcatgtacagagcggcatgtgagcagcagtgacagagtgggcaagccttaccgtggcgtaaagcctgttttcagcattggggatgaagaagaatacgacacagatgaaattgacagttcttcaatgtcagatgatgatagaaaagaggttgtaaacattcagacttggataaacaaaccagatgtcaaacatcattttccttgtaaagaagtaaaagaaagtggacacatgtttcccagtcatctgttggttactgcaacacatatgtactgtttaagggagattgtttcacggaaaggattggcttatatacagtctcgacaagcgctgaattctgtagttaaaattacatccaaaaaaaaacatcctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaagaaattaagacaaccaagagaaacatggacatatacctcctgactgaatactaactggagacctttcatttgctcatggggctgcttaaatagcaggtctaagaaagtgtaaattattataatcaatctgtggacagtaaactttttaaaaatttttcttctgcattttggttttataaaatgatgtattataaaggtcagttattaaattactttgaagtaactgaccctgtgcccttatggactaagtaagggtacagaatgcagttctgttttgaagagctgttttaagggaacatgcatcactttcgggatcaaaaacaactgtacacatacatatctgcagtgtcttcactgaaaattagagatagaattagttgaagagacttccttaattgctacattgttttactcactgagcaatatcagaaactaaaacatagattaataattcactcactgtttctattcttcttaaaaagagtgaaatctttttaatggaatggttgaagattcctgccaactcaaaatacagtacagctagtaaaatgttgaaacatcagtttctaaatcacctttgctccattagctaattttttggacactaaatgcttcaaagataagaaacttcatcctaatgatttctaaagagcagttaaaagcattaaaataagtaggtaggctgttaagattaaaattaacattttggggacagaattgtgtctgtaaaaatgtcattggttttattacaagcggattattttattcatattttaaaacaaatgtttaagccacattgatttatcctcattgaggattatggtctgtgaccacagtaatatccacttatataaatgccaaataatcagagagcttataaagtacaattgtttttgtcatcattttctgaatttctttctcttcttttggttttgtcctctcattgaagttccagtggtttgaaattagttttggacacattgtcttaatgtactgaaaattgctctgctgtattttgcagcgttcttcatttaatttataatggtccatattagacacatttggtaagagaagtccaggaacacatttagggccatggaatagtattttgtaaaatccatttgggaagttgcaatacccacaatctgacatgtcctaaaatgtaagggattatctctaaggggttgatgggagaaatatttagatgtaccctgttaacagccagtcattttgatttacttatggaaatcaagtgaataaaaggcaacataatttgggaaattttattctaatatctaataaaaacagtttgagtggttgaagacatctgcatgaaattgcacctaggtgcattacttgatataactctcccctaaaactgttgtaattgcattttttcccttttcttggcacccctttagaaatgtactgaagtctcatttttcacccatttcagccatgggacatttttcataatattaatgtaaagatgtttgtgttactgtttataaattacaattgtaaataaattactagtttgcccaaaa

SEQ ID NO: 189529 - DNA, 587 bp, Homo sapiens
  Payload ID: 17425
  Gene Symbol: TBC1D23
  Gene Name: TBC1 domain family, member 23
  ENST ID: ENST00000485687
  CDS Start-End: 20-587
gacgtggacgtcaacagcaatggcggaaggagaagatgtgccgccgctgccaacgtcgagcggcgacggctgggaaaaagatcttgaagaagctctggaagcaggaggttgtgatcttgaaacgttgagaaatataattcaaggaagaccgctgcctgctgatctgagggccaaagtttggaagtcactttttaaatctttcttccagattgctctgaatgttgcaggaaaaggtgatagtttggcatcatgggatggtattttagacttgccagaacagaacactattcacaaagattgcctgcagtttattgaccagctttcagtgccagaggagaaggcagcagaattacttttggatattgaatctgtaattaccttttattgtaaatcacgtaacattaaatatagcacatcccttagctggatacatctactgaaaccattggtgcatcttcaactgccacgcagcgatttatacaactgcttttatgccataatgaataagtacattcccagggattgttcccagaaagggagaccatttcatctcttcaggttgctcatccaataccatgagcctgagc

SEQ ID NO: 189530 - DNA, 2074 bp, Homo sapiens
  Payload ID: 17425
  Gene Symbol: TBC1D23
  Gene Name: TBC1 domain family, member 23
  ENST ID: ENST00000475134
  CDS Start-End: 363-2051
aactaagggtaaaatgagagtaaattgactgtatgaagcctgagatttcccacaagaaaacatgctgtgtataccttggcattacattttggttgctgagaacttttgtttcttagacaagcctttaataggccatgcttataaatgaatcttgaataagaaaaagtatgagataaagttcattttaataaataggacttattttttagggaaaaagatcttgaagaagctctggaagcaggaggttgtgatcttgaaacgttgagaaatataattcaaggaagaccgctgcctgctgatctgagggccaaagtttggaagattgctctgaatgttgcaggaaaaggtgatagtttggcatcatgggatggtattttagacttgccagaacagaacactattcacaaagattgcctgcagtttattgggattgttcccagaaagggagaccatttcatctcttcaggttgctcatccaataccatgagcctgagctttgttcttatcttgatacaaagaaaattactccagactcctatgcactcaactggcttggaagtctttttgcatgttactgttccactgaagtcactcaggcaatatgggatggatatctacaacaagcagatccattttttatttatttcttaatgttaattatccttgttaatgcaaaagaagttattttaacacaagagtcagacagcaaagaagaagttatcaagttcttggaaaatactccatccagtctgaatatagaagatatagaagaccttttctctctggctcagtattattgcagcaaaacaccggcttcttttaggaaggataatcaccatctctttggtagtactttgttgggaattaaggatgatgatgcagatctgagtcaggctctttgtctggccatctccgtgtcagagatccttcaagcgaatcagctacaaggggaaggagtccggttctttgtggtggattgccgtcctgcagaacaatataatgctgggcatttatcaactgctttccacttagattcagacctgatgcttcagaatccatctgagtttgcacagtcagtaaaatccttgctggaagcacagaagcagtccattgagtctggctccatagctggtggggagcacctctgttttatgggcagtggcagggaggaagaagacatgtatatgaacatggtcctggcacactttttacagaaaaacaaagaatatgtgagtattgccagtggaggatttatggcactgcagcagcacctggcagacattaatgtggatggaccagaaaatggatatggccattggattgctagtacctcaggctcaaggagcagtatcaattctgttgatggtgaatctcctaatggctcaagtgatagaggaatgaaatcactagtaaataaaatgactgtggctttgaagacaaaatccgttaatgtcagggaaaaagttatcagttttatagagaatacatcaactcctgtggatcgaatgtctttcaatcttccttggccagacagatcatgtacagagcggcatgtgagcagcagtgacagagtgggcaagccttaccgtggcgtaaagcctgttttcagcattggggatgaagaagaatacgacacagatgaaattgacagttcttcaatgtcagatgatgatagaaaagaggttgtaaacattcagacttggataaacaaaccagatgtcaaacatcattttccttgtaaagaagtaaaagaaagtggacacatgtttcccagtcatctgttggttactgcaacacatatgtactgtttaagggagattgtttcacggaaaggattggcttatatacagtctcgacaagcgctgaattctgtagttaaaattacatccaaaaaaaaacatcctgaactcattaccttcaagtatggaaatagcagtgcttcaggaatagaaatcttggcaatcgaaaggtatttgattccaaatgcaggggatgcaactaaagccataaaacagcagatcatgaaagttttggatgctttggaaagttaatataaaagaaaattatataaaaa

SEQ ID NO: 189531 - DNA, 559 bp, Homo sapiens
  Payload ID: 17425
  Gene Symbol: TBC1D23
  Gene Name: TBC1 domain family, member 23
  ENST ID: ENST00000471098
  CDS Start-End: 47-559
tgaaaaggggcagggcttgaaatgagttaaatattgagaattacagatggaaagcagggaaaaagatcttgaagaagctctggaagcaggaggttgtgatcttgaaacgttgagaaatataattcaaggaagaccgctgcctgctgatctgagggccaaagtttggaagattgctctgaatgttgcaggaaaaggtgatagtttggcatcatgggatggtattttagacttgccagaacagaacactattcacaaagattgcctgcagtttattgaccagctttcagtgccagaggagaaggcagcagaattacttttggatattgaatctgtaattaccttttattgtaaatcacgtaacattaaatatagcacatcccttagctggatacatctactgaaaccattggtgcatcttcaactgccacgcagcgatttatacaactgcttttatgccataatgaataagtacattcccagggattgttcccagaaagggagaccatttcatctcttcaggttgctcatccaataccatgagcctgagctttgttcttat

SEQ ID NO: 189532 - DNA, 4340 bp, Homo sapiens
  Payload ID: 17426
  Gene Symbol: TBC1D24
  Gene Name: TBC1 domain family, member 24
  Uniprot ID: Q9ULP9
  ENST ID: ENST00000293970
  CDS Start-End: 134-1813
agaaagcggcgcgcggagggtgtgagatggcagacaggtttgcaggaaaccctcagaaagggggctggaggatttagccactctgtcctccccttccggcagtccagggcctcctcccgagcacagcggcgctatggactctccaggatacaactgcttcgtggacaaagacaagatggacgctgccatccaggacctggggcccaaggagctgagctgcactgaactgcaggaactgaagcagctggcgcgccagggctactgggcccaaagccacgccctgcggggaaaggtgtaccagcgcctgatccgggacattccctgccgcacggtcacgcctgacgccagcgtgtacagcgacatcgtgggcaagatcgtgggcaagcacagcagcagctgcctgccgctgcccgagttcgtggacaacacgcaggtgcccagctactgcctgaatgcacgcggcgagggggccgtgcgcaagatcctcctgtgcctggccaaccagttccccgacatctccttctgccccgccctgccggccgtggtggccctgctgctgcactacagcatcgacgaggccgagtgcttcgagaaggcctgccgcatcctggcctgcaatgaccccggcaggaggctgatcgaccagagcttcctggcctttgagtcgtcctgcatgacgtttggggacctggtgaacaagtactgccaggcggcccacaagctgatggtggccgtgtcggaggatgtcctgcaggtctatgcggactggcagcgctggctgtttggggagctgcccctctgctacttcgcccgggtctttgacgtcttcctggtggagggctacaaggtgctgtaccgcgtggcgctggccatcctcaagttcttccacaaggtgagggccgggcagccgctggagtcggacagcgtgaagcaggacatccgcacgttcgtcagagacatcgcgaagacggtgtcccctgagaagctgctggagaaagcgttcgccatccgcctcttctcccgcaaggagatccagctcctgcagatggccaatgagaaagccctgaagcagaagggcatcaccgtgaagcagaagagtgtgtcactttctaaaaggcagtttgtacacttggccgtccatgcagagaacttccgctcggagatcgtcagcgtgagggagatgagagacatctggtcctgggtccccgagcgctttgccctgtgccagccccttctgctgttctcctccctgcagcacgggtacagcctggccaggttctacttccagtgtgaaggacatgagcctaccctcttgctcatcaagaccacgcagaaggaggtgtgtggtgcttacctgtccacagactggagtgagagaaataagtttggaggcaaactgggcttctttgggaccggagaatgctttgtgtttaggctgcagcctgaggtgcagcgctacgagtgggtggtgatcaagcaccccgagctgaccaagcccccacccttgatggctgccgagcccaccgccccactcagccactccgcctcctcagaccccgctgaccgcctctcgcccttcctggccgctcgccacttcaacctgccctccaagaccgagtccatgttcatggcggggggcagcgactgcctcatcgtcgggggaggaggcggccaggcgctctacatcgatggggacctgaaccggggccgcacaagccactgcgacaccttcaacaaccagcccctctgctccgagaacttcctcattgctgccgtggaggcctggggcttccaggaccctgacacccagtgacggcctgtgccacggtgactgagccgtggtggggcggtgggccgaggctgggctgccgcctcgggcagcagagagcagatgaaacccccatgtggtaggcagggttgggggacggcaggaccccatggccaagcctggcgttgcctggacctgctgctgcctctacctggggtttgggctgggcttccccagtccacctgcatctgggtcagagctggagggcctgctgtgcccccagccccacccagagctggcataggaagtaccttcctcctccgtggaggcttccatagcccaaggccttgggagtgtctgggtcttgctgcccctgagcctctctaggcagcctgagcccctggggtgggagtacaacggcagtgggaacgtgcagctaagggtgggcctgtggtgccccctgctggtgccgcatagcatcgcgccctcctgagcagggccctgcagcctggctggctggcgactgaatcccagcgtagatcccgagaacagactggcacccttgggcctgccccctggcggaccccaccccctgtcctgggcgtttgccccagttccctccccaggcctcctgggccacctctcacattaacccttcttggctgcctctgaggctcccctgggctgcgtttgggagctgctgggtgggaggaggagggtgggatttgtgctgggctccacccccagggagggtgggagctggagggggatgtcacatgtccttgtgtttctgcagagcctgaagcttttgctgggcctccctgcgtgttcccatctgaagaggtagccccgggagaggccctcagggaccgacccagaccagcaagctccatttccaggggtctgcccagagaagcctggacccagggggcttctcagctcccctcccttccagcccaggcctccttgagctcctgtagcctctgcagctgcccatttcacctctttgtcattgcaatgacctggggcccagggtcacgcccaagcccctctttgtggcatgctcatctcagtgcagccccaactgcttctctgcaccaggccccgtgccctcccctggccctggccacacagcacctccttggccaccttgcatggatgcatgtcctccctctgtccctcttgtggtgctgtggctggccacgtgtcagggttttctgtgagcctctcaccttacagcctttgggcccctgggcccctgccctgcctgagccctgcgctggccagacgcaggtaggtgccaggggaggccttgcctctgggcactatagggggcagccccctgccttgtgacctccctccatgccccatgacctccttcaactcgtcttgagggtctggtcaccacggaggggagaagggagacacagaggcccaagtggctgttctgggaccatggaagcctgggtcacagaggcaggtaccagcagtcctgcccccacccccgtccctgctggcctccagccagtgccacttggagtcccctgcaccgtgccactttccatccccacaccattgcctgctcctcccatggggctttagcctcccctgaccatctgctcatgtagcctctgactgggcgcacagtggtgcaggaggaaggaccgggaaccctgtgtggctttgggcaagctgacaaacccgtctggaactcagtttccccagctgtgaaatggggccagtccccatgccctgctgtcctcctcacaggactgttgagaggctcgcagggggatggggtgaatccctctcacggggagaggtatgggagggaagtcgccactcatctcagcccaccgcagccctccaggcccccgcctgagcccctgaggccctcatctgtaccgccagctttggtgttcattaaacatggtcttgctgcatcaactccagggctccaagctgagtctgatctcttcagccagaggggcctccgggggcttcctgggcctacagccaagcaggtgtgggaggctgcccgctgtagtgctcacccacattctatgactggaatgctgcaagcctcttccagagggagccctccaggagcagggaagtcatatccgtggaccatttgtaggtttccctctgcaaacttcctgaactgggtggtgatttttctggcgagttaagtccagcaggttctgcgtggctgcccccagggggccccacccgggccttccagtgatctggaccaggaagacggattgctgctgggtcatgatttccacatcatgagcgaagttctttgttttttgtgtgcatgcaaaatattgtttctttaaatttaatatcttttcctaacttttctactaacctagaaggtatgtgtgattattatcttttttattcttatcactgtacttgttagtatctgatattaggtattcccaaatagaacataatttattttgttaatgttctctatttcttcttgattatttattagctttggatgttaaaaattagccaaaagtggctgctctgcctatgaagtagccattctttgttt

SEQ ID NO: 189533 - DNA, 6578 bp, Homo sapiens
  Payload ID: 17426
  Gene Symbol: TBC1D24
  Gene Name: TBC1 domain family, member 24
  Uniprot ID: Q9ULP9
  ENST ID: ENST00000567020
  CDS Start-End: 141-1802
gctgaggagaaagcggcgcgcggagggtgtgagatggcagacaggtttgcaggaaaccctcagaaagggggctggaggatttagccactctgtcctccccttccggcagtccagggcctcctcccgagcacagcggcgctatggactctccaggatacaactgcttcgtggacaaagacaagatggacgctgccatccaggacctggggcccaaggagctgagctgcactgaactgcaggaactgaagcagctggcgcgccagggctactgggcccaaagccacgccctgcggggaaaggtgtaccagcgcctgatccgggacattccctgccgcacggtcacgcctgacgccagcgtgtacagcgacatcgtgggcaagatcgtgggcaagcacagcagcagctgcctgccgctgcccgagttcgtggacaacacgcaggtgcccagctactgcctgaatgcacgcggcgagggggccgtgcgcaagatcctcctgtgcctggccaaccagttccccgacatctccttctgccccgccctgccggccgtggtggccctgctgctgcactacagcatcgacgaggccgagtgcttcgagaaggcctgccgcatcctggcctgcaatgaccccggcaggaggctgatcgaccagagcttcctggcctttgagtcgtcctgcatgacgtttggggacctggtgaacaagtactgccaggcggcccacaagctgatggtggccgtgtcggaggatgtcctgcaggtctatgcggactggcagcgctggctgtttggggagctgcccctctgctacttcgcccgggtctttgacgtcttcctggtggagggctacaaggtgctgtaccgcgtggcgctggccatcctcaagttcttccacaaggtgagggccgggcagccgctggagtcggacagcgtgaagcaggacatccgcacgttcgtcagagacatcgcgaagacggtgtcccctgagaagctgctggagaaagcgttcgccatccgcctcttctcccgcaaggagatccagctcctgcagatggccaatgagaaagccctgaagcagaagggcatcaccgtgaagcagaagaggcagtttgtacacttggccgtccatgcagagaacttccgctcggagatcgtcagcgtgagggagatgagagacatctggtcctgggtccccgagcgctttgccctgtgccagccccttctgctgttctcctccctgcagcacgggtacagcctggccaggttctacttccagtgtgaaggacatgagcctaccctcttgctcatcaagaccacgcagaaggaggtgtgtggtgcttacctgtccacagactggagtgagagaaataagtttggaggcaaactgggcttctttgggaccggagaatgctttgtgtttaggctgcagcctgaggtgcagcgctacgagtgggtggtgatcaagcaccccgagctgaccaagcccccacccttgatggctgccgagcccaccgccccactcagccactccgcctcctcagaccccgctgaccgcctctcgcccttcctggccgctcgccacttcaacctgccctccaagaccgagtccatgttcatggcggggggcagcgactgcctcatcgtcgggggaggaggcggccaggcgctctacatcgatggggacctgaaccggggccgcacaagccactgcgacaccttcaacaaccagcccctctgctccgagaacttcctcattgctgccgtggaggcctggggcttccaggaccctgacacccagtgacggcctgtgccacggtgactgagccgtggtggggcggtgggccgaggctgggctgccgcctcgggcagcagagagcagatgaaacccccatgtggtaggcagggttgggggacggcaggaccccatggccaagcctggcgttgcctggacctgctgctgcctctacctggggtttgggctgggcttccccagtccacctgcatctgggtcagagctggagggcctgctgtgcccccagccccacccagagctggcataggaagtaccttcctcctccgtggaggcttccatagcccaaggccttgggagtgtctgggtcttgctgcccctgagcctctctaggcagcctgagcccctggggtgggagtacaacggcagtgggaacgtgcagctaagggtgggcctgtggtgccccctgctggtgccgcatagcatcgcgccctcctgagcagggccctgcagcctggctggctggcgactgaatcccagcgtagatcccgagaacagactggcacccttgggcctgccccctggcggaccccaccccctgtcctgggcgtttgccccagttccctccccaggcctcctgggccacctctcacattaacccttcttggctgcctctgaggctcccctgggctgcgtttgggagctgctgggtgggaggaggagggtgggatttgtgctgggctccacccccagggagggtgggagctggagggggatgtcacatgtccttgtgtttctgcagagcctgaagcttttgctgggcctccctgcgtgttcccatctgaagaggtagccccgggagaggccctcagggaccgacccagaccagcaagctccatttccaggggtctgcccagagaagcctggacccagggggcttctcagctcccctcccttccagcccaggcctccttgagctcctgtagcctctgcagctgcccatttcacctctttgtcattgcaatgacctggggcccagggtcacgcccaagcccctctttgtggcatgctcatctcagtgcagccccaactgcttctctgcaccaggccccgtgccctcccctggccctggccacacagcacctccttggccaccttgcatggatgcatgtcctccctctgtccctcttgtggtgctgtggctggccacgtgtcagggttttctgtgagcctctcaccttacagcctttgggcccctgggcccctgccctgcctgagccctgcgctggccagacgcaggtaggtgccaggggaggccttgcctctgggcactatagggggcagccccctgccttgtgacctccctccatgccccatgacctccttcaactcgtcttgagggtctggtcaccacggaggggagaagggagacacagaggcccaagtggctgttctgggaccatggaagcctgggtcacagaggcaggtaccagcagtcctgcccccacccccgtccctgctggcctccagccagtgccacttggagtcccctgcaccgtgccactttccatccccacaccattgcctgctcctcccatggggctttagcctcccctgaccatctgctcatgtagcctctgactgggcgcacagtggtgcaggaggaaggaccgggaaccctgtgtggctttgggcaagctgacaaacccgtctggaactcagtttccccagctgtgaaatggggccagtccccatgccctgctgtcctcctcacaggactgttgagaggctcgcagggggatggggtgaatccctctcacggggagaggtatgggagggaagtcgccactcatctcagcccaccgcagccctccaggcccccgcctgagcccctgaggccctcatctgtaccgccagctttggtgttcattaaacatggtcttgctgcatcaactccagggctccaagctgagtctgatctcttcagccagaggggcctccgggggcttcctgggcctacagccaagcaggtgtgggaggctgcccgctgtagtgctcacccacattctatgactggaatgctgcaagcctcttccagagggagccctccaggagcagggaagtcatatccgtggaccatttgtaggtttccctctgcaaacttcctgaactgggtggtgatttttctggcgagttaagtccagcaggttctgcgtggctgcccccagggggccccacccgggccttccagtgatctggaccaggaagacggattgctgctgggtcatgatttccacatcatgagcgaagttctttgttttttgtgtgcatgcaaaatattgtttctttaaatttaatatcttttcctaacttttctactaacctagaaggtatgtgtgattattatcttttttattcttatcactgtacttgttagtatctgatattaggtattcccaaatagaacataatttattttgttaatgttctctatttcttcttgattatttattagctttggatgttaaaaattagccaaaagtggctgctctgcctatgaagtagccattctttgtttaaaaaaaaaaaaagccaacatttgttgaaactgcataataaattatcatttgtttttagaaacattcaaagaattattttttgattttttttttttttgggacagagtcacccaggctggagtgcagtggcatgatcttggctcactgcaacctccgcctcctgggttcaagcgattctcctgcctcagcctcctgagtagctgggattacaggcatacgccaccacgcccagctaaattttttttgtatttttagtagaggcagggtttcactgtgttggtcaggctggtcttgaactcctgacctcgtgatccacccccccctcagcctcccaaagtgctgggattacaggcgtgagccaccgcgcctagcctattttttaatttttttgaatagaccactttgtgctgaataaatgtttaacatttatttttaaaacaacaattgcacctaatttaaaatagtttattaaatgaattcattaaagcagattatatgcctttggggcttcagaaaatcagtttaagcaaaagaacttatgagagtaagtcatttgtacttgaattttttcagagttttaatgaactaaagtattttaatttttctatttttgtaagccgcatacttcattttttgagtttttcagtggaatttgttttaaaacgttttgaagatttcagaggccttcatatttctcttatccactttctgaacccataaagcctttgcagtctccttgagtagtttatatttagtaatttagttgtgtacctttttattttgaagtaatttttgatttgcagaagagttgcagagacggtacagggtttccatgtaccctcaccttcccccaagtcaatatcaaaacaaagaaataagcattgttgcattgctgttaactaaaccacaggcctattgagattgtcccttttttttttttttttttttttgagacagagtctcgctctgtcgcccaggctggagtgcagtggcgcgatctcggctcaccgcaagccccgcctcccggattcacgccattctcctgcctcagcctcctgagtagctgggactacaggcacctgctaccacacccggctaatttttttatatttttagtagagatggggtttcaccgtgttagccaggatggtcttgatctcctgacctcgtgatctgccctcctcggcctcccaaagtgctgggattacaggcgtgagcaaccgcgcccagccgagattgccccgtttttttcccactgtccaggaatcgatttaatttttacagttgtttactttctcacatttttactaagtccagaatatcatcaaactcacaaaaccactggtcaaaaaaacccaaatggccactaattaggcaatacagcacctgcctcaaatttgggttcatatagatttttttcctccctttttgtggagaacatagtcttgctgtgttgcccaggctagtcttgaactcctggactcaagcaatcctcccgcctctgcctccctaaattctgggattacaggcgtgagctgctgtgcccagctcatccagattcttgctggttctctttctcagcctaaatgtcttgtttgcgtggagaaattatcaaatgaagcaggagtgccaaacaagcctcataggctcttcaccctacaacatctatgttaggtagaaaagtatgtggatttttaaaaatcatctggtataaagagtttttaagaactatcttcatcatcttagtatcagattgtgcttgagaagttaggtacaatgtaatgtgattcattgctaaaaacaaaatgcctcccacaattgcagactcactcattttaccaaactatggaatttgtcaacaccttttcttgggaccaaggaagcaaagtcagtggataccgtgtcctgtagacatgtcacttgtgataaggcacggacaacatgaactggcaaaaacattggcatttggtcaaatgcttatgagctaaggatagaagggaaaaaatagttgtgtgaatgattttacctcttagttcttacgaaggatggttatcgggctggaaaaatgtttattggactgatgctttggagcctctcaatgaatgtaataaaaaaaatgtgtagtgagcacaaatgtatggatttgcagcacaatccaactttgaaaatgtgaaaataagtgagttagtgatatgtttggttggtgttaatttgagtcctaaataaaatcgagaactggtaaaagaag

SEQ ID NO: 189534 - DNA, 571 bp, Homo sapiens
  Payload ID: 17426
  Gene Symbol: TBC1D24
  Gene Name: TBC1 domain family, member 24
  ENST ID: ENST00000569874
  CDS Start-End: 1-60
gagaacttcctcattgctgccgtggaggcctggggcttccaggaccctgacacccagtgacggcctgtgccacggtgactgagccgtggtggggcggtgggccgaggctgggctgccgcctcgggcagcagagagcagatgaaacccccatgtgagcctgaagcttttgctgggcctccctgcgtgttcccatctgaagaggtagccccgggagaggccctcagggaccgacccagaccagcaagctccatttccaggggtctgcccagagaagcctggacccagggggcttctcagctcccctcccttccagcccaggcctccttgagctcctgtagcctctgcagctgcccatttcacctctttgtcattgcaatgacctggggcccagggtcacgcccaagcccctctttgtggcatgctcatctcagtgcagccccaactgcttctctgcaccaggccccgtgccctcccctggccctggccacacagcacctccttggccaccttgcatggatgcatgtcctccctctgtccctcttgtggtgctgtggctggccacgtgtcaggg

SEQ ID NO: 189535 - DNA, 5324 bp, Homo sapiens
  Payload ID: 17426
  Gene Symbol: TBC1D24
  Gene Name: TBC1 domain family, member 24
  ENST ID: ENST00000564879
  CDS Start-End: 1-208
ggtccccgagcgctttgccctgtgccagccccttctgctgttctcctccctgcagcacgggtacagcctggccaggtgtgtggtgcttacctgtccacagactggagtgagagaaataagtttggaggcaaactgggcttctttgggaccggagaatgctttgtgtttaggctgcagcctgaggtgcagcgctacgagtgggtggtgatcaagcaccccgagctgaccaagcccccacccttgatggctgccgagcccaccgccccactcagccactccgcctcctcagaccccgctgaccgcctctcgcccttcctggccgctcgccacttcaacctgccctccaagaccgagtccatgttcatggcggggggcagcgactgcctcatcgtcgggggaggaggcggccaggcgctctacatcgatggggacctgaaccggggccgcacaagccactgcgacaccttcaacaaccagcccctctgctccgagaacttcctcattgctgccgtggaggcctggggcttccaggaccctgacacccagtgacggcctgtgccacggtgactgagccgtggtggggcggtgggccgaggctgggctgccgcctcgggcagcagagagcagatgaaacccccatgtggtaggcagggttgggggacggcaggaccccatggccaagcctggcgttgcctggacctgctgctgcctctacctggggtttgggctgggcttccccagtccacctgcatctgggtcagagctggagggcctgctgtgcccccagccccacccagagctggcataggaagtaccttcctcctccgtggaggcttccatagcccaaggccttgggagtgtctgggtcttgctgcccctgagcctctctaggcagcctgagcccctggggtgggagtacaacggcagtgggaacgtgcagctaagggtgggcctgtggtgccccctgctggtgccgcatagcatcgcgccctcctgagcagggccctgcagcctggctggctggcgactgaatcccagcgtagatcccgagaacagactggcacccttgggcctgccccctggcggaccccaccccctgtcctgggcgtttgccccagttccctccccaggcctcctgggccacctctcacattaacccttcttggctgcctctgaggctcccctgggctgcgtttgggagctgctgggtgggaggaggagggtgggatttgtgctgggctccacccccagggagggtgggagctggagggggatgtcacatgtccttgtgtttctgcagagcctgaagcttttgctgggcctccctgcgtgttcccatctgaagaggtagccccgggagaggccctcagggaccgacccagaccagcaagctccatttccaggggtctgcccagagaagcctggacccagggggcttctcagctcccctcccttccagcccaggcctccttgagctcctgtagcctctgcagctgcccatttcacctctttgtcattgcaatgacctggggcccagggtcacgcccaagcccctctttgtggcatgctcatctcagtgcagccccaactgcttctctgcaccaggccccgtgccctcccctggccctggccacacagcacctccttggccaccttgcatggatgcatgtcctccctctgtccctcttgtggtgctgtggctggccacgtgtcagggttttctgtgagcctctcaccttacagcctttgggcccctgggcccctgccctgcctgagccctgcgctggccagacgcaggtaggtgccaggggaggccttgcctctgggcactatagggggcagccccctgccttgtgacctccctccatgccccatgacctccttcaactcgtcttgagggtctggtcaccacggaggggagaagggagacacagaggcccaagtggctgttctgggaccatggaagcctgggtcacagaggcaggtaccagcagtcctgcccccacccccgtccctgctggcctccagccagtgccacttggagtcccctgcaccgtgccactttccatccccacaccattgcctgctcctcccatggggctttagcctcccctgaccatctgctcatgtagcctctgactgggcgcacagtggtgcaggaggaaggaccgggaaccctgtgtggctttgggcaagctgacaaacccgtctggaactcagtttccccagctgtgaaatggggccagtccccatgccctgctgtcctcctcacaggactgttgagaggctcgcagggggatggggtgaatccctctcacggggagaggtatgggagggaagtcgccactcatctcagcccaccgcagccctccaggcccccgcctgagcccctgaggccctcatctgtaccgccagctttggtgttcattaaacatggtcttgctgcatcaactccagggctccaagctgagtctgatctcttcagccagaggggcctccgggggcttcctgggcctacagccaagcaggtgtgggaggctgcccgctgtagtgctcacccacattctatgactggaatgctgcaagcctcttccagagggagccctccaggagcagggaagtcatatccgtggaccatttgtaggtttccctctgcaaacttcctgaactgggtggtgatttttctggcgagttaagtccagcaggttctgcgtggctgcccccagggggccccacccgggccttccagtgatctggaccaggaagacggattgctgctgggtcatgatttccacatcatgagcgaagttctttgttttttgtgtgcatgcaaaatattgtttctttaaatttaatatcttttcctaacttttctactaacctagaaggtatgtgtgattattatcttttttattcttatcactgtacttgttagtatctgatattaggtattcccaaatagaacataatttattttgttaatgttctctatttcttcttgattatttattagctttggatgttaaaaattagccaaaagtggctgctctgcctatgaagtagccattctttgtttaaaaaaaaaaaaagccaacatttgttgaaactgcataataaattatcatttgtttttagaaacattcaaagaattattttttgattttttttttttttgggacagagtcacccaggctggagtgcagtggcatgatcttggctcactgcaacctccgcctcctgggttcaagcgattctcctgcctcagcctcctgagtagctgggattacaggcatacgccaccacgcccagctaaattttttttgtatttttagtagaggcagggtttcactgtgttggtcaggctggtcttgaactcctgacctcgtgatccacccccccctcagcctcccaaagtgctgggattacaggcgtgagccaccgcgcctagcctattttttaatttttttgaatagaccactttgtgctgaataaatgtttaacatttatttttaaaacaacaattgcacctaatttaaaatagtttattaaatgaattcattaaagcagattatatgcctttggggcttcagaaaatcagtttaagcaaaagaacttatgagagtaagtcatttgtacttgaattttttcagagttttaatgaactaaagtattttaatttttctatttttgtaagccgcatacttcattttttgagtttttcagtggaatttgttttaaaacgttttgaagatttcagaggccttcatatttctcttatccactttctgaacccataaagcctttgcagtctccttgagtagtttatatttagtaatttagttgtgtacctttttattttgaagtaatttttgatttgcagaagagttgcagagacggtacagggtttccatgtaccctcaccttcccccaagtcaatatcaaaacaaagaaataagcattgttgcattgctgttaactaaaccacaggcctattgagattgtcccttttttttttttttttttttttgagacagagtctcgctctgtcgcccaggctggagtgcagtggcgcgatctcggctcaccgcaagccccgcctcccggattcacgccattctcctgcctcagcctcctgagtagctgggactacaggcacctgctaccacacccggctaatttttttatatttttagtagagatggggtttcaccgtgttagccaggatggtcttgatctcctgacctcgtgatctgccctcctcggcctcccaaagtgctgggattacaggcgtgagcaaccgcgcccagccgagattgccccgtttttttcccactgtccaggaatcgatttaatttttacagttgtttactttctcacatttttactaagtccagaatatcatcaaactcacaaaaccactggtcaaaaaaacccaaatggccactaattaggcaatacagcacctgcctcaaatttgggttcatatagatttttttcctccctttttgtggagaacatagtcttgctgtgttgcccaggctagtcttgaactcctggactcaagcaatcctcccgcctctgcctccctaaattctgggattacaggcgtgagctgctgtgcccagctcatccagattcttgctggttctctttctcagcctaaatgtcttgtttgcgtggagaaattatcaaatgaagcaggagtgccaaacaagcctcataggctcttcaccctacaacatctatgttaggtagaaaagtatgtggatttttaaaaatcatctggtataaagagtttttaagaactatcttcatcatcttagtatcagattgtgcttgagaagttaggtacaatgtaatgtgattcattgctaaaaacaaaatgcctcccacaattgcagactcactcattttaccaaactatggaatttgtcaacaccttttcttgggaccaaggaagcaaagtcagtggataccgtgtcctgtagacatgtcacttgtgataaggcacggacaacatgaactggcaaaaacattggcatttggtcaaatgcttatgagctaaggatagaagggaaaaaatagttgtgtgaatgattttacctcttagttcttacgaaggatggttatcgggctggaaaaatgtttattggactgatgctttggagcctctcaatgaatgtaataaaaaaaatgtgtagtgagcacaaatgtatggatttgcagcacaatccaactttgaaaatgtgaaaataagtgagttagtgatatgtttggttggtgttaatttgagtcctaaataaaatcgagaactggtaaaagaa

SEQ ID NO: 189536 - DNA, 344 bp, Homo sapiens
  Payload ID: 17426
  Gene Symbol: TBC1D24
  Gene Name: TBC1 domain family, member 24
  ENST ID: ENST00000562105
  CDS Start-End: 184-344
gtgtttggggcctgctgtcacagcactgggagccttggagagagatggggagctgggatccccaggagggtgtgagatggcagacaggtttgcaggaaaccctcagaaagggggctggaggatttagccactctgtcctccccttccggcagtccagggcctcctcccgagcacagcggcgctatggactctccaggatacaactgcttcgtggacaaagacaagatggacgctgccatccaggacctggggcccaaggagctgagctgcactgaactgcaggaactgaagcagctggcgcgccagggctactgggcccaaagccacgccctgcggggaaaggt

SEQ ID NO: 189537 - DNA, 4382 bp, Homo sapiens
  Payload ID: 17426
  Gene Symbol: TBC1D24
  Gene Name: TBC1 domain family, member 24
  Uniprot ID: Q9ULP9
  ENST ID: ENST00000627285
  CDS Start-End: 226-1887
gtgaatgttctagctgcaagagaaaccggagtggtctggtcactcaaccaaaacctgctgaagcagacccctggggcacactgggaacttctaccatcccaggtggaaagggtgtgagatggcagacaggtttgcaggaaaccctcagaaagggggctggaggatttagccactctgtcctccccttccggcagtccagggcctcctcccgagcacagcggcgctatggactctccaggatacaactgcttcgtggacaaagacaagatggacgctgccatccaggacctggggcccaaggagctgagctgcactgaactgcaggaactgaagcagctggcgcgccagggctactgggcccaaagccacgccctgcggggaaaggtgtaccagcgcctgatccgggacattccctgccgcacggtcacgcctgacgccagcgtgtacagcgacatcgtgggcaagatcgtgggcaagcacagcagcagctgcctgccgctgcccgagttcgtggacaacacgcaggtgcccagctactgcctgaatgcacgcggcgagggggccgtgcgcaagatcctcctgtgcctggccaaccagttccccgacatctccttctgccccgccctgccggccgtggtggccctgctgctgcactacagcatcgacgaggccgagtgcttcgagaaggcctgccgcatcctggcctgcaatgaccccggcaggaggctgatcgaccagagcttcctggcctttgagtcgtcctgcatgacgtttggggacctggtgaacaagtactgccaggcggcccacaagctgatggtggccgtgtcggaggatgtcctgcaggtctatgcggactggcagcgctggctgtttggggagctgcccctctgctacttcgcccgggtctttgacgtcttcctggtggagggctacaaggtgctgtaccgcgtggcgctggccatcctcaagttcttccacaaggtgagggccgggcagccgctggagtcggacagcgtgaagcaggacatccgcacgttcgtcagagacatcgcgaagacggtgtcccctgagaagctgctggagaaagcgttcgccatccgcctcttctcccgcaaggagatccagctcctgcagatggccaatgagaaagccctgaagcagaagggcatcaccgtgaagcagaagaggcagtttgtacacttggccgtccatgcagagaacttccgctcggagatcgtcagcgtgagggagatgagagacatctggtcctgggtccccgagcgctttgccctgtgccagccccttctgctgttctcctccctgcagcacgggtacagcctggccaggttctacttccagtgtgaaggacatgagcctaccctcttgctcatcaagaccacgcagaaggaggtgtgtggtgcttacctgtccacagactggagtgagagaaataagtttggaggcaaactgggcttctttgggaccggagaatgctttgtgtttaggctgcagcctgaggtgcagcgctacgagtgggtggtgatcaagcaccccgagctgaccaagcccccacccttgatggctgccgagcccaccgccccactcagccactccgcctcctcagaccccgctgaccgcctctcgcccttcctggccgctcgccacttcaacctgccctccaagaccgagtccatgttcatggcggggggcagcgactgcctcatcgtcgggggaggaggcggccaggcgctctacatcgatggggacctgaaccggggccgcacaagccactgcgacaccttcaacaaccagcccctctgctccgagaacttcctcattgctgccgtggaggcctggggcttccaggaccctgacacccagtgacggcctgtgccacggtgactgagccgtggtggggcggtgggccgaggctgggctgccgcctcgggcagcagagagcagatgaaacccccatgtggtaggcagggttgggggacggcaggaccccatggccaagcctggcgttgcctggacctgctgctgcctctacctggggtttgggctgggcttccccagtccacctgcatctgggtcagagctggagggcctgctgtgcccccagccccacccagagctggcataggaagtaccttcctcctccgtggaggcttccatagcccaaggccttgggagtgtctgggtcttgctgcccctgagcctctctaggcagcctgagcccctggggtgggagtacaacggcagtgggaacgtgcagctaagggtgggcctgtggtgccccctgctggtgccgcatagcatcgcgccctcctgagcagggccctgcagcctggctggctggcgactgaatcccagcgtagatcccgagaacagactggcacccttgggcctgccccctggcggaccccaccccctgtcctgggcgtttgccccagttccctccccaggcctcctgggccacctctcacattaacccttcttggctgcctctgaggctcccctgggctgcgtttgggagctgctgggtgggaggaggagggtgggatttgtgctgggctccacccccagggagggtgggagctggagggggatgtcacatgtccttgtgtttctgcagagcctgaagcttttgctgggcctccctgcgtgttcccatctgaagaggtagccccgggagaggccctcagggaccgacccagaccagcaagctccatttccaggggtctgcccagagaagcctggacccagggggcttctcagctcccctcccttccagcccaggcctccttgagctcctgtagcctctgcagctgcccatttcacctctttgtcattgcaatgacctggggcccagggtcacgcccaagcccctctttgtggcatgctcatctcagtgcagccccaactgcttctctgcaccaggccccgtgccctcccctggccctggccacacagcacctccttggccaccttgcatggatgcatgtcctccctctgtccctcttgtggtgctgtggctggccacgtgtcagggttttctgtgagcctctcaccttacagcctttgggcccctgggcccctgccctgcctgagccctgcgctggccagacgcaggtaggtgccaggggaggccttgcctctgggcactatagggggcagccccctgccttgtgacctccctccatgccccatgacctccttcaactcgtcttgagggtctggtcaccacggaggggagaagggagacacagaggcccaagtggctgttctgggaccatggaagcctgggtcacagaggcaggtaccagcagtcctgcccccacccccgtccctgctggcctccagccagtgccacttggagtcccctgcaccgtgccactttccatccccacaccattgcctgctcctcccatggggctttagcctcccctgaccatctgctcatgtagcctctgactgggcgcacagtggtgcaggaggaaggaccgggaaccctgtgtggctttgggcaagctgacaaacccgtctggaactcagtttccccagctgtgaaatggggccagtccccatgccctgctgtcctcctcacaggactgttgagaggctcgcagggggatggggtgaatccctctcacggggagaggtatgggagggaagtcgccactcatctcagcccaccgcagccctccaggcccccgcctgagcccctgaggccctcatctgtaccgccagctttggtgttcattaaacatggtcttgctgcatcaactccagggctccaagctgagtctgatctcttcagccagaggggcctccgggggcttcctgggcctacagccaagcaggtgtgggaggctgcccgctgtagtgctcacccacattctatgactggaatgctgcaagcctcttccagagggagccctccaggagcagggaagtcatatccgtggaccatttgtaggtttccctctgcaaacttcctgaactgggtggtgatttttctggcgagttaagtccagcaggttctgcgtggctgcccccagggggccccacccgggccttccagtgatctggaccaggaagacggattgctgctgggtcatgatttccacatcatgagcgaagttctttgttttttgtgtgcatgcaaaatattgtttctttaaatttaatatcttttcctaacttttctactaacctagaaggtatgtgtgattattatcttttttattcttatcactgtacttgttagtatctgatattaggtattcccaaatagaacataatttattttgttaatgttctctatttcttcttgattatttattagctttggatgttaaaaattagccaaaagtggc

SEQ ID NO: 189538 - DNA, 4180 bp, Homo sapiens
  Payload ID: 17426
  Gene Symbol: TBC1D24
  Gene Name: TBC1 domain family, member 24
  ENST ID: ENST00000630263
  CDS Start-End: 195-1214
cgcgtgcgcagaaaggccggcgcggcaggctgaggagaaagcggcgcgcggaggtgaatgttctagctgcaagagaaaccggagtggtctggtcactcaaccaaaacctgctgaagcagacccctggggcacactgggaacttctaccatcccaggtggaaagtccagggcctcctcccgagcacagcggcgctatggactctccaggatacaactgcttcgtggacaaagacaagatggacgctgccatccaggacctggggcccaaggagctgagctgcactgaactgcaggaactgaagcagctggcgcgccagggctactgggcccaaagccacgccctgcggggaaaggtgtaccagcgcctgatccgggacattccctgccgcacggtcacgcctgacgccagcgtgtacagcgacatcgtgggcaagatcgtgggcaagcacagcagcagctgcctgccgctgcccgagttcgtggacaacacgcaggtgcccagctactgcctgaatgcacgcggcgagggggccgtgcgcaagatcctcctgtgcctggccaaccagttccccgacatctccttctgccccgccctgccggccgtggtggccctgctgctgcactacagcatcgacgaggccgagtgcttcgagaaggcctgccgcatcctggcctgcaatgaccccggcaggaggctgatcgaccagagcttcctggcctttgagtcgtcctgcatgacgtttggggacctggtgaacaagtactgccaggcggcccacaagctgatggtggccgtgtcggaggatgtcctgcaggtctatgcggactggcagcgctggctgtttggggagctgcccctctgctacttcgcccgggtctttgacgtcttcctggtggagggctacaaggtgctgtaccgcgtggcgctggccatcctcaagttcttccacaaggtgagggccgggcagccgctggagtcggacagcgtgaagcaggacatccgcacgttcgtcagagacatcgcgaagacggtgtcccctgagaagctgctggagaaagcgttcgccatccgcctcttctcccgcaaggagatccagctcctgcagatggccaatgagaaagccctgaagcagaagggcatcaccgtgaagcagaagagtttgtacacttggccgtccatgcagagaacttccgctcggagatcgtcagcgtgagggagatgagagacatctggtcctgggtccccgagcgctttgccctgtgccagccccttctgctgttctcctccctgcagcacgggtacagcctggccaggttctacttccagtgtgaaggacatgagcctaccctcttgctcatcaagaccacgcagaaggaggtgtgtggtgcttacctgtccacagactggagtgagagaaataagtttggaggcaaactgggcttctttgggaccggagaatgctttgtgtttaggctgcagcctgaggtgcagcgctacgagtgggtggtgatcaagcaccccgagctgaccaagcccccacccttgatggctgccgagcccaccgccccactcagccactccgcctcctcagaccccgctgaccgcctctcgcccttcctggccgctcgccacttcaacctgccctccaagaccgagtccatgttcatggcggggggcagcgactgcctcatcgtcgggggaggaggcggccaggcgctctacatcgatggggacctgaaccggggccgcacaagccactgcgacaccttcaacaaccagcccctctgctccgagaacttcctcattgctgccgtggaggcctggggcttccaggaccctgacacccagtgacggcctgtgccacggtgactgagccgtggtggggcggtgggccgaggctgggctgccgcctcgggcagcagagagcagatgaaacccccatgtggtaggcagggttgggggacggcaggaccccatggccaagcctggcgttgcctggacctgctgctgcctctacctggggtttgggctgggcttccccagtccacctgcatctgggtcagagctggagggcctgctgtgcccccagccccacccagagctggcataggaagtaccttcctcctccgtggaggcttccatagcccaaggccttgggagtgtctgggtcttgctgcccctgagcctctctaggcagcctgagcccctggggtgggagtacaacggcagtgggaacgtgcagctaagggtgggcctgtggtgccccctgctggtgccgcatagcatcgcgccctcctgagcagggccctgcagcctggctggctggcgactgaatcccagcgtagatcccgagaacagactggcacccttgggcctgccccctggcggaccccaccccctgtcctgggcgtttgccccagttccctccccaggcctcctgggccacctctcacattaacccttcttggctgcctctgaggctcccctgggctgcgtttgggagctgctgggtgggaggaggagggtgggatttgtgctgggctccacccccagggagggtgggagctggagggggatgtcacatgtccttgtgtttctgcagagcctgaagcttttgctgggcctccctgcgtgttcccatctgaagaggtagccccgggagaggccctcagggaccgacccagaccagcaagctccatttccaggggtctgcccagagaagcctggacccagggggcttctcagctcccctcccttccagcccaggcctccttgagctcctgtagcctctgcagctgcccatttcacctctttgtcattgcaatgacctggggcccagggtcacgcccaagcccctctttgtggcatgctcatctcagtgcagccccaactgcttctctgcaccaggccccgtgccctcccctggccctggccacacagcacctccttggccaccttgcatggatgcatgtcctccctctgtccctcttgtggtgctgtggctggccacgtgtcagggttttctgtgagcctctcaccttacagcctttgggcccctgggcccctgccctgcctgagccctgcgctggccagacgcaggtaggtgccaggggaggccttgcctctgggcactatagggggcagccccctgccttgtgacctccctccatgccccatgacctccttcaactcgtcttgagggtctggtcaccacggaggggagaagggagacacagaggcccaagtggctgttctgggaccatggaagcctgggtcacagaggcaggtaccagcagtcctgcccccacccccgtccctgctggcctccagccagtgccacttggagtcccctgcaccgtgccactttccatccccacaccattgcctgctcctcccatggggctttagcctcccctgaccatctgctcatgtagcctctgactgggcgcacagtggtgcaggaggaaggaccgggaaccctgtgtggctttgggcaagctgacaaacccgtctggaactcagtttccccagctgtgaaatggggccagtccccatgccctgctgtcctcctcacaggactgttgagaggctcgcagggggatggggtgaatccctctcacggggagaggtatgggagggaagtcgccactcatctcagcccaccgcagccctccaggcccccgcctgagcccctgaggccctcatctgtaccgccagctttggtgttcattaaacatggtcttgctgcatcaactccagggctccaagctgagtctgatctcttcagccagaggggcctccgggggcttcctgggcctacagccaagcaggtgtgggaggctgcccgctgtagtgctcacccacattctatgactggaatgctgcaagcctcttccagagggagccctccaggagcagggaagtcatatccgtggaccatttgtaggtttccctctgcaaacttcctgaactgggtggtgatttttctggcgagttaagtccagcaggttctgcgtggctgcccccagggggccccacccgggccttccagtgatctggaccaggaagacggattgctgctgggtcatgatttccacatcatgagcgaagttctttgttttttgtgtgcatgcaaaatattgtttctttaaatttaatatcttttcctaacttttctac

SEQ ID NO: 189539 - DNA, 4042 bp, Homo sapiens
  Payload ID: 17427
  Gene Symbol: TBC1D25
  Gene Name: TBC1 domain family, member 25
  Uniprot ID: Q3MII6
  ENST ID: ENST00000376771
  CDS Start-End: 342-2408
cgtcagtttaacacctccgtgaatccggaagtatgctgtcaaaacaaccaaaccacggggctgggggaggcggggcctcagtaggcgtctgcacgctagctgaaatagagcaaaatgcccgacttttgggggcggggctcctggcaacagcactctaggcgcaggcgcagaggcgacctccaggcagggccaggtgggagggacggtggggggtagggtcgcgcggcgccctctgcgcctgcgccccggcacgaggtggggcggcgggcgtcagtacagtagagtgtgcgccggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaagaaatgtgagagcttcttgccgccagagttccgctcttttgctgtagatccccagatcacctcgctcgacgtgttgcagcacatcctcatccgagcctttgatttgagtgggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatgaaggtcactgtggtttgtgtgtttctctgcctcctccctgggttttgctgtagatggagtcctcaggggccctttacctgatggaggggaaatacttcacttggtggagagaggctccagcttcccccttgtgatggggagagtggatgctgacaatcagttcccaaaggtgagcccaggtggagcactgcttgaggaaggcctgagtctgtttttttggtacatccatcggcctgtaagggtctgtattatggctgtgaatatatgttttcaggacagccccctggatgagagataagagagttcctggctcaaaaaaggacaagattctttactgagattgggaagtatgggctacttagaaacgttggagcagccacccctggcattccacatgtcaccatttctaggatcttggcctctctgtgaggtttatgcaccaatgctggcagccctgggcaggggcctcggcctcctttttgttttccacttcagacaggtaccgtgcagatgttaacaaggtttgagcgaggtgcatctcacacaagtgtgaaagcccaatcatcacattgttgaattacaaaaggatctagggctcctattcttgtcacttgctttggagccagtttgaaagactggcctagcccatgcctagcggccctaaactgggattccagctcacagcacctgtcttaaccatttcagcagtagaaaccacttatttaccttctccatctcactaatatggacaaacaacaagcactgataaaacgcaggccctaatagaattcacttcgttatttggaggataatgatcaaaaaaaggtcctttttcccactgacatgctcagagggtgggattctctcacaggccaggtgctgtcatccacaaaggatgggtgaaataactggggtcctcaggtcacggtctagccacaccagcttctcccaagtactaaccaggcttgaccctgcttagcttcagaggtcagacaagatctggcatgttcaggatggtatggctgtagaccaggctgggttctggccagagctgttgcactaggcaatgctgccagagatgaggaggcatcagggcagtcatcccttctgctgtttgccccaagaatgccatacaaacctggggatgacccttaaaagtctcccgtcacccccagtattggggggaagctgactattcctcagatgatagcccagtcacttgaagaacaggacaagactattctgtgtctagggggctcaagcactgtgtgtgggtctaacgaatgcattttgtggaaatgggctcagactccccaaagggccatccaacctatgggagtgtctggccttctgaggtcctgaaatgtctcttttgtcagtaaacagctaataccctc

SEQ ID NO: 189540 - DNA, 691 bp, Homo sapiens
  Payload ID: 17427
  Gene Symbol: TBC1D25
  Gene Name: TBC1 domain family, member 25
  ENST ID: ENST00000418627
  CDS Start-End: 1-691
atggcaacagcctccggggcctcggacttgtctggctccggagcgcccccgcccggtgtgggagctcaggcggcggcggccgctgaggaggaggagcgagaggtggtgcgggtccgagtcaagcatggtgatggggcccctggtggcctaccccatgtcttctctccccagaaatgtgagagcttcttgccgccagagttccgctcttttgctgtagatccccagatcacctcgctcgacgtgttgcagcacatcctcatccgagcctttgatttgagtgggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctct

SEQ ID NO: 189541 - DNA, 884 bp, Homo sapiens
  Payload ID: 17427
  Gene Symbol: TBC1D25
  Gene Name: TBC1 domain family, member 25
  Uniprot ID: Q3MII6
  ENST ID: ENST00000481090
  CDS Start-End: 62-364
agagtgtgcgccggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaagaaatgtgagagcttcttgccgccagagttccgctcttttgctgtagatccccagatcacctcgctcgacgtgttgcagcacatcctcatccgagcctttgatttgagtgggcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccaccca

SEQ ID NO: 189542 - DNA, 2015 bp, Homo sapiens
  Payload ID: 17428
  Gene Symbol: TBC1D26
  Gene Name: TBC1 domain family, member 26
  Uniprot ID: Q9HBT8
  ENST ID: ENST00000412988
  CDS Start-End: 80-1615
cacgcctggctccgctccttcttacgcatgcgcgactccgagctggccaaagaagttcgtcccctttgtgaggcccgggatgggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaataaaactgattatattcctggtccctgaacgatcctatagagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccacgtcagtgccctggaggtgaaggtaagagcctgtgcctgctgcgtgggaggctgcttca

SEQ ID NO: 189543 - DNA, 1868 bp, Homo sapiens
  Payload ID: 17428
  Gene Symbol: TBC1D26
  Gene Name: TBC1 domain family, member 26
  ENST ID: ENST00000437605
  CDS Start-End: 251-1003
cttgccgtctctatgtctggagctcttagagataagacatagaggtgtctggttctgagaaaaggaagttttgctaagtgagagacacaactgactcaactgactcagaaaactgattatattcctggtccctgaacgatcctatagagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccacgtcagtgccctggaggtgaagcaaagacgcaaggaaagtaaacgtaccaacaagtggcaaaagatgcttgcagactggacaaaatataggagcaccaagaagctgtctcaaagagtatacaaagtcattcccctggcggtacggggccgggcgtggtcacttttgctagatattgacagaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgaggtgggctaccacagggacctgagccgcatcactgccatcctcctcctgtgtctgccagaggaagatgctttctgggcgcttacccagttgctcgctggtgagaggcactccctgtggtattctacagcccaaatactgcctggctcgagaggctcctatcgcaccaggagcaggtgctgcacaagtccttcccaaagatcatgagacacctgggcaaggaagggctgtgcattgagggttccatgctgacgaggctcctccggtgtttccttgatgggaaatccttcgggctcaccctgagactgtgggatgtgttcatcttggagggcgcgcgggtactgacagccatggtgcatgcatcattcaaaatacacaggaagcacctcatgaagctttcctggagcactgtctgggagtttcaggagcgactctctcagagctgggccctggaggacaacgcggtcctcaggaaccttcaaacctctatgaaggaactcacaaaaaaacactgggacctgccacccccagggagcttgctacaaaatgcacattgctataccatagcctggggcttgcaatccaaggctggcaaggattcctgcacgtcaagggcctcaggtgactttcatgcacacccaagtcagaaggctctcctgaatcctggatgtcaccttcctgcccaaaaaaggaggaacgagggtcaaccagcagcagaccagtcacaaaaagagatgaaatgtgagtgcatggccttcctgacacccagacaaaactttgggcacaaagccaggctgcagctctggccactgacttggaccagggatgcccccatgcaggccggtgtgccctggctgctcttgacaccctctggctcctgacaccctctcttcggctgcctgcgttaggaagggagaacctgccagttttcagaagaaaatgtagctttattataacataggaaagactgcaagttattacgggaggaggaggaggcctgaaacagctcctgaaaatgagagggaaaaggaaggtgtaaatatgttggtaataaaatctccaaccacagcat

SEQ ID NO: 189544 - DNA, 1616 bp, Homo sapiens
  Payload ID: 17428
  Gene Symbol: TBC1D26
  Gene Name: TBC1 domain family, member 26
  Uniprot ID: Q86UD7
  ENST ID: ENST00000469477
  CDS Start-End: 245-997
gtctctatgtctggagctcttagagataagacatagaggtgtctggttctgagaaaaggaagttttgctaagtgagagacacaactgactcaactgactcagaaaactgattatattcctggtccctgaacgatcctatagagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccacgtcagtgccctggaggtgaagcaaagacgcaaggaaagtaaacgtaccaacaagtggcaaaagatgcttgcagactggacaaaatataggagcaccaagaagctgtctcaaagagtatacaaagtcattcccctggcggtacggggccgggcgtggtcacttttgctagatattgacagaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgaggtgggctaccacagggacctgagccgcatcactgccatcctcctcctgtgtctgccagaggaagatgctttctgggcgcttacccagttgctcgctggtgagaggcactccctgtggtattctacagcccaaatactgcctggctcgagaggctcctatcgcaccaggagcaggtgctgcacaagtccttcccaaagatcatgagacacctgggcaaggaagggctgtgcattgagggttccatgctgacgaggctcctccggtgtttccttgatgggaaatccttcgggctcaccctgagactgtgggatgtgttcatcttggagggcgcgcgggtactgacagccatggtgcatgcatcattcaaaatacacaggaagcacctcatgaagctttcctggagcactgtctgggagtttcaggagcgactctctcagagctgggccctggaggacaacgcggtcctcaggaaccttcaaacctctatgaaggaactcacaaaaaaacactgggacctgccacccccagggagcttgctacaaaatgcacattgctataccatagcctggggcttgcaatccaaggctggcaaggattcctgcacgtcaagggcctcaggtgactttcatgcacacccaagtcagaaggctctcctgaatcctggatgtcaccttcctgcccaaaaaaggaggaacgagggtcaaccagcagcagaccagtcacaaaaagagatgaaatattgttcactgttggcatagaggaatactactgattttcgtatgttaattttgtatcctgcaacttaactaaatttgtttaacta

SEQ ID NO: 189545 - DNA, 4262 bp, Homo sapiens
  Payload ID: 17428
  Gene Symbol: TBC1D26
  Gene Name: TBC1 domain family, member 26
  Uniprot ID: Q9HBT8
  ENST ID: ENST00000413242
  CDS Start-End: 320-1885
aagaagttcgtcccctttgtgaggcccgggatgggaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaataaaactgattatattcctggtccctgaacgatcctatagagacatccagtccctgactccacctgcctccaggtgcccagaacagcccatcgtggggacttcaccctcagcaagtggacgccgtttgtcctgccagggcagggacaccgagctggggcagcagtggacttggggcatgagcaggttgatgtcagaaaatacaccaataacctcgggattgtgcatgagatggagctgccccacgtcagtgccctggaggtgaaggtaagagcctgtgcctgctgcgtgggaggctgcttcagggactgggaatcgggtggtcggtaaggcagagggggtggcctgtgggcctgtgtggtggtgagtgggccacggctgtcactgggaggggtggcctttcctgctggactctgttcccatgaggacttgaccaaaacccaaaccaagaactgcagtcctggctcagagtccactgcctgtttgaaccaagaccccagctgaaggctggacctgaccaaaacttggggcatttatggcctgaggatggcatgtcatggcatcaccattccagactaccagctccagttccttcagagggtctcagcccctggggcctgccctttcctggcttcttcaagttgggtcccttcagggccccaaagccctggacccagcatccacgggccactgtcagacgcctggcagctccgctaactccatcatggctcatttgacagcaaagacgcaaggaaagtaaacgtaccaacaagtggcaaaagatgcttgcagactggacaaaatataggagcaccaagaaggtaacatggggaggaagtggcccgcgtgactgctctctgcagagccaggagacaggcacccatggttgtgacctggcaccgtctgcctctcagtgggtgggtggtaccccatccttgccataggactgcaggcctgttcgccagctttgctctgcggggtcgccccatgtcctttctcactggagtgttcttctgtctgtagctgtctcaaagagtatacaaagtcattcccctggcggtacggggccgggcgtggtcacttttgctagatattgacagaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgaggtgggctaccacagggacctgagccgcatcactgccatcctcctcctgtgtctgccagaggaagatgctttctgggcgcttacccagttgctcgctggtgagaggcactccctgtggtattctacagcccaaatactgcctggctcgagaggctcctatcgcaccaggagcaggtgctgcacaagtccttcccaaagatcatgagacacctgggcaaggaagggctgtgcattgagggttccatgctgacgaggctcctccggtgtttccttgatgggaaatccttcgggctcaccctgagactgtgggatgtgttcatcttggagggcgcgcgggtactgacagccatggtgcatgcatcattcaaaatacacaggaagcacctcatgaagctttcctggagcactgtctgggagtttcaggagcgactctctcagagctgggccctggaggacaacgcggtcctcaggaaccttcaaacctctatgaaggaactcacaaaaaaacactgggacctgccacccccagggagcttgctacaaaatgcacattgctataccatagcctggggcttgcaatccaaggctggcaaggattcctgcacgtcaagggcctcaggtgactttcatgcacacccaagtcagaaggctctcctgaatcctggatgtcaccttcctgcccaaaaaaggaggaacgagggtcaaccagcagcagaccagtcacaaaaagagatgaaatgtgagtgcatggccttcctgacacccagacaaaactttgggcacaaagccaggctgcagctctggccactgacttggaccagggatgcccccatgcaggccggtgtgccctggctgctcttgacaccctctggctcctgacaccctctcttcggctgcctgcgttaggaagggagaacctgccagttttcagaagaaaatgtagctttattataacataggaaagactgcaagttattacgggaggaggaggaggcctgaaacagctcctgaaaatgagagggaaaaggaaggtgtaaatatgttggtaataaaatctccaaccac

SEQ ID NO: 189546 - DNA, 1583 bp, Homo sapiens
  Payload ID: 17428
  Gene Symbol: TBC1D26
  Gene Name: TBC1 domain family, member 26
  Uniprot ID: Q86UD7
  ENST ID: ENST00000579428
  CDS Start-End: 245-877
gtctctatgtctggagctcttagagataagacatagaggtgtctggttctgagaaaaggaagttttgctaagtgagagacacaactgactcaactgactcagaaaactgattatattcctggtccctgaacgatcctatagagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccacgtcagtgccctggaggtgaagcaaagacgcaaggaaagtaaacgtaccaacaagtggcaaaagatgcttgcagactggacaaaatataggagcaccaagaagctgtctcaaagagtatacaaagtcattcccctggcggtacggggccgggcgtggtcacttttgctagatattgacagaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgtgagtattcccgggcagcgatattcctgggacatgtgcccatattcacaggcatgggtgtctcttgggggtgttgcaacttcttgaaaattcagtgtttgtccaccaggacgtagtaggcaggacttcagctcgctgctggcagaaaagggctgaagcccagactcctggtgtcacatggacccaatcaccacgtctcagatgaagaaacgaccttcccctcctggtgttgccccaaagcctaggagcttggcagggtcccacacaggatggtccttgtaggagacaggtttgacaagttgctgaggtgcctgatgggccaggcacttgtcatgaaatgagtttgcatcctgggggagcctcttcttcactggaaacctggcaaggatccaatttcccctttgcctgaaccccataggagcatagcagatagggaggggggtcacccaggtggctgttcctgcttggcccccactttccagaccattccaggcagggagagctgctgagctgactgcatgagctgcccacatggaggacccagccaccccttatgtccggcaggcagcccttgggctgttgcaggaccttttgtgtggtggtcagcgccccgctgcctgccctcgtggcaggtgcagttcacaggtgctgccccaggcctggcacagtggcctccccagcctggcccaggggagggagcatgaacaatccctgactgtgccctttcgggccatgtgagcttggacacttgctgcaggagtccccccatgctccttgtcaactgagttgtgcg

SEQ ID NO: 189547 - DNA, 570 bp, Homo sapiens
  Payload ID: 17428
  Gene Symbol: TBC1D26
  Gene Name: TBC1 domain family, member 26
  ENST ID: ENST00000580596
  CDS Start-End: 413-570
actggtgctgagcactcgcccacctgtccacttgccgtctctatgtctggagctcttagagataagacatagaggtgtctggttctgagaaaaggaagttttgctaagtgagagacacaactgactcaactgactcaggaaaacaaagtcccctcctgtattgacagctgggaattgtggtgtccaccgtcctcgacctgcgacggggtctccatgagcacagaggctgctctggagtcaatagatcatcttttccccaaaccaaactgcttggctggcgttgttcctgaagcggcttcactggccagaagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaaggcaatatcatcattactaagtatgagcagggacaccgagctggggcagcagtggacttggggcatgagcaggttgatgtcagaaaatacaccaataacctcgggattgtgca

SEQ ID NO: 189548 - DNA, 648 bp, Homo sapiens
  Payload ID: 17428
  Gene Symbol: TBC1D26
  Gene Name: TBC1 domain family, member 26
  ENST ID: ENST00000464963
  CDS Start-End: 451-648
gagcactcgcccacctgtccacttgccgtctctatgtctggagctcttagagataagacatagaggtgtctggttctgagaaaaggaagttttgctaagtgagagacacaactgactcaactgactcagaaactctgtggcgatgggtgctgtccccaaatgtagccattccacaggaaaacaaagtcccctcctgtattgacagctgggaattgtggtgtccaccgtcctcgacctgcgacggggtctccatgagcacagaggctgctctggagtcaatagatcatcttttccccaaaccaaactgcttggctggcgttgttcctgaagcggcttcactggccagaagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccacgtcagtgccctggaggtgaag

SEQ ID NO: 189549 - DNA, 539 bp, Homo sapiens
  Payload ID: 17428
  Gene Symbol: TBC1D26
  Gene Name: TBC1 domain family, member 26
  ENST ID: ENST00000578506
  CDS Start-End: 499-539
gtgttgtgcagcacttgcacataagacgcacacaggtgtctggttctgtggtgcatgaacgacttttctaagtgagagacacagcagcctgagcagactcaggtgagtgacctctgggcagatgccgaggagggtcacccctgagcactcaccgggtgcatgttctgcactgacggcgtggaccatcctctcctttgtcctcacagaaactctgtggcgatgggtgctgtccccaaatgtagccattccacagctgggaattgtggtgtccaccgtcctcgacctgcgacggggtctccatgagcacagaggctgctctggagtcaatagatcatcttttccccaaaccaaactgcttggctggcgttgttcctgaagcggcttcactggccagaagacatccagtccctgactccacctgcctccaggtgcccagaacagcccatcgtggggacttcaccctcagcaagtggacgccgtttgtcctgccagggcaggatggagatggatggggacccgtataacctgcctgcccaggg

SEQ ID NO: 189550 - DNA, 553 bp, Homo sapiens
  Payload ID: 17428
  Gene Symbol: TBC1D26
  Gene Name: TBC1 domain family, member 26
  ENST ID: ENST00000584301
  CDS Start-End: 507-553
actggtgctgagcactcgcccacctgtccacttgccgtctctatgtctggagctcttagagataagacatagaggtgtctggttctgagaaaaggaagttttgctaagtgagagacacaactgactcaactgactcaggaaaacaaagtcccctcctgtattgacagctgggaattgtggtgtccaccgtcctcgacctgcgacggggtctccatgagcacagaggctgctctggagtcaatagatcatcttttccccaaaccaaactgcttggctggcgttgttcctgaagcggcttcactggccagagtgagtgagaattggggtagaacggagcagtcaccagatgtcttgcttcctacagaaaactgattatattcctggtccctgaacgatcctatagagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaagg

SEQ ID NO: 189551 - DNA, 1978 bp, Homo sapiens
  Payload ID: 17428
  Gene Symbol: TBC1D26
  Gene Name: TBC1 domain family, member 26
  Uniprot ID: Q86UD7
  ENST ID: ENST00000612583
  CDS Start-End: 413-1045
actggtgctgagcactcgcccacctgtccacttgccgtctctatgtctggagctcttagagataagacatagaggtgtctggttctgagaaaaggaagttttgctaagtgagagacacaactgactcaactgactcaggaaaacaaagtcccctcctgtattgacagctgggaattgtggtgtccaccgtcctcgacctgcgacggggtctccatgagcacagaggctgctctggagtcaatagatcatcttttccccaaaccaaactgcttggctggcgttgttcctgaagcggcttcactggccagaagacatccagtccctgactccacctgcctccaggtgcccagaacagcccatcgtggggacttcaccctcagcaagtggacgccgtttgtcctgccagggcaggatggagatggatggggacccgtataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccacgtcagtgccctggaggtgaagcaaagacgcaaggaaagtaaacgtaccaacaagtggcaaaagatgcttgcagactggacaaaatataggagcaccaagaagctgtctcaaagagtatacaaagtcattcccctggcggtacggggccgggcgtggtcacttttgctagatattgacagaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgtgagtattcccgggcagcgatattcctgggacatgtgcccatattcacaggcatgggtgtctcttgggggtgttgcaacttcttgaaaattcagtgtttgtccaccaggacgtagtaggcaggacttcagctcgctgctggcagaaaagggctgaagcccagactcctggtgtcacatggacccaatcaccacgtctcagatgaagaaacgaccttcccctcctggtgttgccccaaagcctaggagcttggcagggtcccacacaggatggtccttgtaggagacaggtttgacaagttgctgaggtgcctgatgggccaggcacttgtcatgaaatgagtttgcatcctgggggagcctcttcttcactggaaacctggcaaggatccaatttcccctttgcctgaaccccataggagcatagcagatagggaggggggtcacccaggtggctgttcctgcttggcccccactttccagaccattccaggcagggagagctgctgagctgactgcatgagctgcccacatggaggacccagccaccccttatgtccggcaggcagcccttgggctgttgcaggaccgtggccagttcttggtattgctcaagtcccctgggccttcagactggcgggtgacttcaagggaccaaccaccctgggcctctcctgggacaaacacttgccttcacccactatcgatgtcttgctcagccctcagaggagcgtggttggcgtggattacttcatgccttgattctgccttcccggaaaccacggtggcagcaggcttggatgtcaccaagccaccgtgtttcatgctatttctggaagttctcgcctttgtggcctcggaaaggaaggcgatctggtgctttggggaaggccctcgggatgctcctccagatggtcttcttcaggccttttgctcagcattggtctgatcagttctgccagctctgggccatgatctcttggcactggcgcggctttccttcaataattccataaactcc

SEQ ID NO: 189552 - DNA, 2789 bp, Homo sapiens
  Payload ID: 17429
  Gene Symbol: TBC1D28
  Gene Name: TBC1 domain family, member 28
  Uniprot ID: Q2M2D7
  ENST ID: ENST00000345096
  CDS Start-End: 701-1333
gaggcagggtctggtcctggaagagccactgggacagagcccctgtgggtggggtggagggtgaaattcttggtccaagtctgtgccctaagcttggtccccacaggaggaggtcactgatggttgctgtgggacccactggacacatggggtccttcatctaggagtggggtggggagccctctgccctcaggcagttgtggaaaatgaaggagccctggagggctgcctggagggtgacaatcgtctctcctggtcaaagaggcttggggactggaaccctcctgcagcgtcccattctctctgtctggtcctctagaggccttgccttccgtttgccccgagtattcctgggggggacggttcccccaggtgttctctaggactaaggccccagcgttctcttgttctttcttggtgacccaggaaaacaaagtcccctcctgtattgacagctgggaattgtggtgtccaccgtcctcgacctgcgacggggtctccatgagcacagaggctgctctggagtcaacagatcatcttttccccaaaccaaactgcttggctggcgttgttcctgaaggggcttcactggccagaagacatccagtccctgactccacctgcctccaggtgcccagaacagcccatcgtggggacttcaccctcagcaagtggacgccgtttgtcctgccagggcaggatggagatggatgaggacccggataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccgcgtcagtgccctggaggtgaagcaaagacgcaaggaaagtaaacgtaccaacaagtggcaaaagatgcttgcagactggacaaaatataggagcaccaagaagctgtctcaaagagtatgcaaagtcattcccctggcggtgcggggccgggcgttgtcacttttgctagatattgacaaaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgtgagtattcccgggcagcgatattcctggtacctgtgcccatattcacaggcatgggtgtctctcgggggtgttgcaacttcttgaaaattcagcgtttgtccaccaggacgtagtaggcaggacttcagctcgctgctggcagaaaagggttgaagcccagactcctggtctcacatggacccaatcaccacatctcagatgaagaaatgaccttcccctcctggtgttgccccaaagcctaggagcttggcagggtcccacacaggatggtccttgtaggagacaggtttgacaagttgctgaggtgcctgatgggccaggcacttgtcatgaaatgagtttgcatcctgggggagcctcttcttcactggaaacctggcaaggatccaatttcccctttgcctgatccccacaggagcatagcagatagggaggggggtcacccaggtggctcttcctgcttggcccccactttccagaccattccaggcagggagagctgctgagctgactgcatgagctgcccacatggaggacccagccaccccttatgttcggcaggcagcccttgggctgttgcaggaccgtggccagttcttggtattgctcaagtcccctgggccttcagactggcgggtgacttcaagggagcaaccatcctgggcctctcctgggacaaacacttgccttcacccactatcgatgtcttgctcagccctcagaggagcgtggttggcgtggattacttcatgccttgattctgccttcccggaaaccacggtggcagcaggcttggatgtcaccaagtcaccgtgtttcatgctatttctggaggttctcgcctttgtggcctcggaaaggaaggcgatctggtgctttggggaaagccctcgggatgctcctccagatggtcttcttcaggccttttgctcagcattggtctgatcagttctgccagctctgggccatgatctcttggcactggcgcggctttccttcaataattccataaactccagacttcgtgtcttttgcatggaaagcacgcggtgcccatttcatcgacaccgcaccccggagtccaaacgtcagccctgcgggtgttgggtttgttagggacaatttcgggctcaggtgcagggggcgcttccccagcgcgggcgcttcctgggccccatctgaggccgtgggctcctggcaggaggacctggagttttcagatccccgggaaggatgcatttcccccactctcgggcacaagctgccctttgctggcgttgggcacggatcatggcctcgcagaagcccgcgacagcgtggagcaggtggtgcccccgcccgggactcctggtgggtgatggctccgggaggccttggctgggacagagtggggcctccgggtcggtcagcggcccgagcccggctgcggctctcggaggcttgggtttggaagacaccgcctgccatcccgcggcgcctctcggggtccgctcccccggactggccctgcccaccgcgcgcgagtagtagcgggcggcca

SEQ ID NO: 189553 - DNA, 1978 bp, Homo sapiens
  Payload ID: 17429
  Gene Symbol: TBC1D28
  Gene Name: TBC1 domain family, member 28
  Uniprot ID: Q2M2D7
  ENST ID: ENST00000405044
  CDS Start-End: 413-1045
actggtgctgagcactcgcccacctgtccgcttgccgtctctatgtctggagctcttagagataagacatagaggtgtctggttctgagaaaaggaagttttgctaagtgagagacacaactgactcaactgactcaggaaaacaaagtcccctcctgtattgacagctgggaattgtggtgtccaccgtcctcgacctgcgacggggtctccatgagcacagaggctgctctggagtcaacagatcatcttttccccaaaccaaactgcttggctggcgttgttcctgaaggggcttcactggccagaagacatccagtccctgactccacctgcctccaggtgcccagaacagcccatcgtggggacttcaccctcagcaagtggacgccgtttgtcctgccagggcaggatggagatggatgaggacccggataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccgcgtcagtgccctggaggtgaagcaaagacgcaaggaaagtaaacgtaccaacaagtggcaaaagatgcttgcagactggacaaaatataggagcaccaagaagctgtctcaaagagtatgcaaagtcattcccctggcggtgcggggccgggcgttgtcacttttgctagatattgacaaaatcaagtcccagaacccaggcaaatataaggtcatgaaggagaagggcaagaggtcctccagaatcatccactgcatccagctagatgtcagccacaccctgcagaaacacatgatgttcatacaaagattcggagtcaagcagcaggaattatgtgacatcctcgtggcctattctgcatataaccctgtgagtattcccgggcagcgatattcctggtacctgtgcccatattcacaggcatgggtgtctctcgggggtgttgcaacttcttgaaaattcagcgtttgtccaccaggacgtagtaggcaggacttcagctcgctgctggcagaaaagggttgaagcccagactcctggtctcacatggacccaatcaccacatctcagatgaagaaatgaccttcccctcctggtgttgccccaaagcctaggagcttggcagggtcccacacaggatggtccttgtaggagacaggtttgacaagttgctgaggtgcctgatgggccaggcacttgtcatgaaatgagtttgcatcctgggggagcctcttcttcactggaaacctggcaaggatccaatttcccctttgcctgatccccacaggagcatagcagatagggaggggggtcacccaggtggctcttcctgcttggcccccactttccagaccattccaggcagggagagctgctgagctgactgcatgagctgcccacatggaggacccagccaccccttatgttcggcaggcagcccttgggctgttgcaggaccgtggccagttcttggtattgctcaagtcccctgggccttcagactggcgggtgacttcaagggagcaaccatcctgggcctctcctgggacaaacacttgccttcacccactatcgatgtcttgctcagccctcagaggagcgtggttggcgtggattacttcatgccttgattctgccttcccggaaaccacggtggcagcaggcttggatgtcaccaagtcaccgtgtttcatgctatttctggaggttctcgcctttgtggcctcggaaaggaaggcgatctggtgctttggggaaagccctcgggatgctcctccagatggtcttcttcaggccttttgctcagcattggtctgatcagttctgccagctctgggccatgatctcttggcactggcgcggctttccttcaataattccataaactcc

SEQ ID NO: 189554 - DNA, 647 bp, Homo sapiens
  Payload ID: 17429
  Gene Symbol: TBC1D28
  Gene Name: TBC1 domain family, member 28
  ENST ID: ENST00000575220
  CDS Start-End: 451-647
gagcactcgcccacctgtccgcttgccgtctctatgtctggagctcttagagataagacatagaggtgtctggttctgagaaaaggaagttttgctaagtgagagacacaactgactcaactgactcagagactctgtggcgatgggtgctgtccccaaatgtagccattccacaggaaaacaaagtcccctcctgtattgacagctgggaattgtggtgtccaccgtcctcgacctgcgacggggtctccatgagcacagaggctgctctggagtcaacagatcatcttttccccaaaccaaactgcttggctggcgttgttcctgaaggggcttcactggccagaagacatccagtccctgactccacctgcctccaggtgcccagaacagcccatcgtggggacttcaccctcagcaagtggacgccgtttgtcctgccagggcaggatggagatggatgaggacccggataacctgcctgcccaggggcaaggcaatatcatcattactaagtatgagcagggacaccgagctggggcagcagtggacttggggcatgagcaggttgatgtcagaaaatacaccaataacctcgggattgtgcatgagatggagctgccccgcgtcagtgccctggaggtgaa

SEQ ID NO: 189555 - DNA, 539 bp, Homo sapiens
  Payload ID: 17429
  Gene Symbol: TBC1D28
  Gene Name: TBC1 domain family, member 28
  ENST ID: ENST00000575211
  CDS Start-End: 499-539
gtgttgtgcagcacttgcacataagacgcacacaggtgtctggttctgtggtgcatgaacgacttttctaagcgagagacacagcagcctgagcagactcaggtgagtgacctctgggcagatgccgacgagggtcacccctgagcactcaccgggtacatgttctgcactgacggcgtggaccatcctctcctttgtcctcacagagactctgtggcgatgggtgctgtccccaaatgtagccattccacagctgggaattgtggtgtccaccgtcctcgacctgcgacggggtctccatgagcacagaggctgctctggagtcaacagatcatcttttccccaaaccaaactgcttggctggcgttgttcctgaaggggcttcactggccagaagacatccagtccctgactccacctgcctccaggtgcccagaacagcccatcgtggggacttcaccctcagcaagtggacgccgtttgtcctgccagggcaggatggagatggatgaggacccggataacctgcctgcccaggg

SEQ ID NO: 189556 - DNA, 570 bp, Homo sapiens
  Payload ID: 17429
  Gene Symbol: TBC1D28
  Gene Name: TBC1 domain family, member 28
  ENST ID: ENST00000572213
  CDS Start-End: 413-570
actggtgctgagcactcgcccacctgtccgcttgccgtctctatgtctggagctcttagagataagacatagaggtgtctggttctgagaaaaggaagttttgctaagtgagagacacaactgactcaactgactcaggaaaacaaagtcccctcctgtattgacagctgggaattgtggtgtccaccgtcctcgacctgcgacggggtctccatgagcacagaggctgctctggagtcaacagatcatcttttccccaaaccaaactgcttggctggcgttgttcctgaaggggcttcactggccagaagacatccagtccctgactccacctgcctccaggtgcccagaacagcccatcgtggggacttcaccctcagcaagtggacgccgtttgtcctgccagggcaggatggagatggatgaggacccggataacctgcctgcccaggggcaaggcaatatcatcattactaagtatgagcagggacaccgagctggggcagcagtggacttggggcatgagcaggttgatgtcagaaaatacaccaataacctcgggattgtgca

SEQ ID NO: 189557 - DNA, 553 bp, Homo sapiens
  Payload ID: 17429
  Gene Symbol: TBC1D28
  Gene Name: TBC1 domain family, member 28
  ENST ID: ENST00000573652
  CDS Start-End: 507-553
actggtgctgagcactcgcccacctgtccgcttgccgtctctatgtctggagctcttagagataagacatagaggtgtctggttctgagaaaaggaagttttgctaagtgagagacacaactgactcaactgactcaggaaaacaaagtcccctcctgtattgacagctgggaattgtggtgtccaccgtcctcgacctgcgacggggtctccatgagcacagaggctgctctggagtcaacagatcatcttttccccaaaccaaactgcttggctggcgttgttcctgaaggggcttcactggccagagtgagtgagaattggggtagaacggagcagtcaccagatgtcttgcttcctacggaaaactgattatcttcctggtccctgaaccatcctatagagacatccagtccctgactccacctgcctccaggtgcccagaacagcccatcgtggggacttcaccctcagcaagtggacgccgtttgtcctgccagggcaggatggagatggatgaggacccggataacctgcctgcccaggggcaagg

SEQ ID NO: 189558 - DNA, 3018 bp, Homo sapiens
  Payload ID: 17430
  Gene Symbol: TBC1D29
  Gene Name: TBC1 domain family, member 29
  Uniprot ID: Q9UFV1
  ENST ID: ENST00000580161
  CDS Start-End: 2498-2950
gagcaggcggcaccatggactgagcacctcccaggttccaagccctgggccagactggaacatggggggccagaacccaagaggatcctgaggagacagacggcagcaaacaaaatcatgcacaatggtgaaaggtgctctccctgacccatggggacccatggtaggaccctcgggagggtggcaggttggagggcccgtaagcctccccaggcaacactgatagtaccaaaagctggggagattcagggacctggaaactgtcatccaggtctgctgggaacgtgacatggcacagccactttggcagccagttgggcagtggctcacaaagttcaatggacttgaaccacgcgtccccaaagtgtcacagatattgaacccactgatttgaaaactgacgtccacatgaaacctgcaggccaggttcactgcttgattcctcgtcactcacacacggagccttcggggatggccttcaacacgggaatggggagaacaaggctggtcctcccttcaaacggaagacccagtgagaaaagggaacgagccagtgatgcccgcatgaacgtgggtggatcctaggtgcattttgctaagggaaagaagccagacccaataagctaccaaagtaggattcccattcttaggccattgtggaaaaggccaaaccatagggactgagaagcagtctgggtggccaggggctgacggatcggggagaggctgggtgcataggggccaccctggagacttggaggatgaaggagtcgctccaggaggggctggagtggtagccgggagactctgcacattggtttagaaccatggaggacctgtacacccaaagactgaattggcgtgtgtgcaaactgaaaaaaaaaagatcattcagagtgaaaaggatcaggcaagtcactgtacaactgggctatttgcatgtcacagatgtggattttactgaaacatttcttcaacagtcaaagtccctgaagagctcactgcttatctggtgaatcatctgaacctgaaatgggatttgttgttagggtttgtagacaaagtgaaactaacagcatctgcacaacacaaaccaaagccccctttctctgtttcccaggcagcaggaactattctacatcctcctggcatattcgaagtataacccagtgagtattcctggcagtgaggttcccaggccgtatttccatattcacaggagtgggtgtctggtgggagtgtcgttgcttcttttaaagttagtatttgtgacccaccaggatataggaggtaggattccagctcaccgctggcataaacctccagcaagggggtggtctcaaggggtcaagctgagacacagaggagtcagggcctggactcctggtgtcacctgggcctgaccaccacttatcggaacaagcccctcctcctggggctgccccaaagcccgggagcttggcagcatcacacacagaatggtgctatcaggagacattttggacaaggtgctgaagtgcccgatggatatggctcttgtcatgaaatgaatttgcatcctgaggaagtctcttcttcagaggaagccttcccagtcacctctgccctctccgatgacatgagtcctcccaggtgacctcagccctcccaagtgacttacttccacggtgactctggctgttgcaggtggtgggctactgcagggacctgagccacatcgctgccttgttcctcctttatctgcctgaggaggacacattctgggcactggtgcagctgctggccagtgagaggcactcctgcaggcttgttgggagcctttaggacgtctctgctgacggtcccaaaggaacccggaactgaccccccagagcccaagtcagacgcctttcatccccatcagcagaaggcatctcatcctccccgtggctgccctctgtgtcctggagccacgccctccggctctgattctgtgcagctggctctccgcaacctgagagtcctcctgcccttcagttgctcaggctccagctgcccttggtacccacgaaagggtaccaagcccagatggcagcatctccccatcccgtgtcccttggcccagccccacttccaggagacgaccacaaagcccagcacccaccctgttctggccgccccctgtcgtggcctcaaagtcaggcttgccctcccggcaccctggcccaggaggcctccaggggcacctccagccaggctccaggggatgttcccacccctcctccccagggccaaggccacatggtggggtcaccagatgggagggtgggaggcctcggggtctggggggctctgcagctgcccagctcttccagctgatggctccacatcttgggggaaggctctgatttcatgacgggctgggggcttctcaggattccacagcccaaatggcgggacagttcaggggctccaagaccatcaggagcatgtggtacccacatcacaacccaagaccatggggcatctggacaaggaaggtctatgcacacagggttcctcattcagctggcttctccgggtgctgaatgatgggatctctctcgggctcaccccgtgcctgtgggatatgtatttgctggaaggggaacagatgttgatgctgataacaagcattgcctttaaggttcaaaggagcctctatgaagaaactaacaaggaaacatggggacctgccacccccagggccctcaagggcactggaagagccagacccatttgtgagagcctccactcctccctgcaagcgctgacagcctcagagagcagcagaggcccctcactcctgcagactcctccaagggtgccaggacaacaagccttgagccggggagacaagggaatcagtgtctcattatctctaccatctctaccatctcggagagggagatgtggcaggataatagggtaatagtggggtgagggtcagcaggaaaacatgaacaaatgtctctgtgtcataaacaaggttaaggaaaa

SEQ ID NO: 189559 - DNA, 602 bp, Homo sapiens
  Payload ID: 17430
  Gene Symbol: TBC1D29
  Gene Name: TBC1 domain family, member 29
  ENST ID: ENST00000584297
  CDS Start-End: 150-395
ttccagctgatggctccacatcttgggggaaggctctgatttcatgacgggctgggggcttctcaggattccacagcccaaatggcgggacagttcaggggctccaagaccatcaggagcatgtggtacccacatcacaacccaagaccatggggcatctggacaaggaaggtctatgcacacagggttcctcattcagctggcttctccgggtgctgaatgatgggatctctctcgggctcaccccgtgcctgtgggatatgtatttgctggaaggggaacagatgttgatgctgataacaagcattgcctttaaggttcaaaggaggccctcaagggcactggaagagccagacccatttgtgagagcctccactcctccctgcaagcgctgacagcctcagagagcagcagaggcccctcactcctgcagactcctccaagggtgccaggacaacaagccttgagccggggagacaagggaatcagtgtctcattatctctaccatctctaccatctcggagagggagatgtggcaggataatagggtaatagtggggtgagggtcagcaggaaaacatgaacaaatgtctctgtgtca

SEQ ID NO: 189560 - DNA, 652 bp, Homo sapiens
  Payload ID: 17430
  Gene Symbol: TBC1D29
  Gene Name: TBC1 domain family, member 29
  Uniprot ID: Q9UFV1
  ENST ID: ENST00000579181
  CDS Start-End: 150-602
ttccagctgatggctccacatcttgggggaaggctctgatttcatgacgggctgggggcttctcaggattccacagcccaaatggcgggacagttcaggggctccaagaccatcaggagcatgtggtacccacatcacaacccaagaccatggggcatctggacaaggaaggtctatgcacacagggttcctcattcagctggcttctccgggtgctgaatgatgggatctctctcgggctcaccccgtgcctgtgggatatgtatttgctggaaggggaacagatgttgatgctgataacaagcattgcctttaaggttcaaaggagcctctatgaagaaactaacaaggaaacatggggacctgccacccccagggccctcaagggcactggaagagccagacccatttgtgagagcctccactcctccctgcaagcgctgacagcctcagagagcagcagaggcccctcactcctgcagactcctccaagggtgccaggacaacaagccttgagccggggagacaagggaatcagtgtctcattatctctaccatctctaccatctcggagagggagatgtggcaggataatagggtaatagtggggtgagggtcagcaggaaaacatgaacaaatgtctctgtgtcat

SEQ ID NO: 189561 - DNA, 6067 bp, Homo sapiens
  Payload ID: 17431
  Gene Symbol: TBC1D2B
  Gene Name: TBC1 domain family, member 2B
  Uniprot ID: Q9UPU7
  ENST ID: ENST00000300584
  CDS Start-End: 1-2892
atgccgggggccggagcccgggcggaggagggcggcggcggcggcgagggcgcggcgcagggggcggccgcggagcccggggcgggtccggcgcgggagccagcgcggctgtgtggctatctgcagaagctgtcgggcaagggccccctgcgtggctaccgcagccgctggttcgtgttcgacgcgcgccgctgctacctttactatttcaagagtccgcaggacgcgctgcccctcggccacttggacatcgcggacgcctgcttcagctaccagggccccgacgaggcggcggagccgggcacggagccgcccgcgcacttccaggtgcacagcgcgggagccgtcacggtgctcaaggctcccaatcgtcaactcatgacttactggttacaggagcttcagcagaagagatgggaatattgtaacagtcttgacatggtcaagtgggacagcaggacctctccaactcccggggattttcctaagggtcttgtagccagagataacactgatttaatttacccacacccaaatgcttctgcagaaaaagccagaaatgtcctagctgtggagactgtgcctggagagctggtgggagaacaagctgcaaatcagcccgccccagggcatccaaattccattaatttttactctttgaaacagtggggcaatgagctcaagaattcgatgtcttctttccgtcctgggagaggacataatgatagtcggaggactgtgttttataccaatgaagagtgggaacttttagacccaacccctaaggacctagaggagtccatagtacaggaagaaaagaagaagctgacccctgaaggaaacaaaggagtaactggctcaggattcccctttgattttggacgtaacccctacaaaggaaagcgccctttgaaagacataattgggtcgtacaaaaatcgtcacagcagtggtgacccttcaagtgaaggcacatcaggcagtggcagcgtcagcatcaggaagccggcctccgaaatgcaactgcaggtccagagccagcaggaagagctggaacagttaaagaaagacctgtccagtcagaaggagcttgttcgactgctccagcagacagtccggtcatcccagtatgacaagtatttcacaagcagccggctctgtgagggggtcccaaaggacacgctcgagcttctgcaccaaaaggatgatcagattctgggccttaccagccagctggagaggttcagcttggagaaggagagtcttcagcaggaagtaaggacgctgaagagcaaagtgggcgagctcaacgagcagctgggaatgctcatggagaccatccaagccaaggacgaggtcatcatcaagctcagcgagggcgagggcaacgggcctcctcccaccgtggcgcccagctccccttcggttgtgcctgttgccagggaccagctggaactggacaggctgaaagataatctacaggggtacaaaacccaaaacaaatttctaaataaggagattttggaactctcagctctacgaagaaatgcagaaaggagagagagggatctgatggcaaagtattctagcctggaagccaagctctgccagatagaaagtaaatacctgatattgctccaagaaatgaagacaccagtgtgctcagaagaccaggggcccacccgggaggtcatagcccagttgctggaggatgctctgcaggttgagagccaagagcagccggagcaagcatttgttaaacctcatcttgtcagtgaatatgatatttatgggttcaggactgtacctgaggatgatgaggaagagaaattggttgccaaggtccgcgcgttggatctgaagactctctacctcacagaaaaccaggaagtctccactggggtcaagtgggaaaactattttgcaagtacagtgaacagggagatgatgtgctctccagagttaaaaaacctcatccgtgcgggcattccccacgagcaccgttccaaggtgtggaagtggtgtgtggaccgtcacaccaggaagttcaaggacaacactgagcctggccacttccagaccttgctgcagaaggcgctggagaaacagaacccagcctccaagcagattgagctggacttgctgcgaactctgcccaacaacaaacattactcctgccccacctcagaaggcatacagaagttacgcaatgtcctcctcgccttctcctggcggaatccagatatcggctactgtcaaggcctaaacaggttggtggcagtggccctcctgtacctggaacaagaagatgctttctggtgtctcgttaccatagtggaagttttcatgcctcgagactattatacaaagactcttttaggatcccaggtggaccagcgggtgttcagagaccttatgagtgagaagctgcctcggttgcatggccactttgaacagtacaaagtcgactacactctcatcactttcaactggtttctggtggtatttgtggatagtgtcgttagtgacatcctctttaaaatatgggactctttcctttatgaaggaccaaaggttattttccgttttgctctggcactttttaagtacaaggaagaggagattttgaaattgcaagattcgatgtctatatttaagtatctccgctacttcactcgcactatccttgatgctaggaagctgatcagtatctcctttggggacctgaaccctttccccctacgccagatccggaaccgacgcgcctaccacttggagaaagtccggctggagctgaccgagctggaggccatccgtgaggacttcctgcgtgagcgggacaccagccctgacaagggtgagctggtcagtgacgaggaggaggatacctgagtgggctcgggatgctgctcttccttccttcacaaccaaagtgtgcccaaagggtgaaagtgcacttaaaagccagaatgtaacgtgtgtgtcctctggggatctgctgggcagatgtcccaagccaggctgcccttcctcatttcccactgtgcggggggcaggggtgggaggtctaatctgtttacaaccatttccgtgccatgcttttggttacacgtatctcagtcacgctttctgcctggttggtggatcctcaggcttaccagtggctatttgcaagagcctgtttccagcctccgtcagcctgtcggtgctctgaccctctgaaaccttgctttgctgggcatctccccatattctctctcctgtacatagtgggcagtggtgtgtggttttgaatggcagtgctataaaggatgccagctgtgctttaggcacctgtaggccagagggttgctgcctcaggcataaggttggtatgaaaaggggctgccttagaaaagcaggcacatcccttgttcagaaatggccactgtaggaaagcctgtgaacctcccaccagtggctttaagctgccagccatgccccatttctagaatagcctttgctcttccacacgcaacccttccatcagtgtcttccagcctgcatggggagggcctggctgcccagacacccaccctcacttctcatggccagcctgtgtttgcagatcactgggctgctctgtccccagcttgccccgtgccaggcatggctctgtgagattctgtggaatgcccttcttgacttgtggaaatcattcaccaagtacgatgggatgggattccaagtaaacagtggaccgtcatattgcaaagcaggcccacgcctgggctggccttggttgaggggatggaggaatgttttcgggggtgctttgcagggcagtggtgcagccgcagcgtgaacgctcttggacagctgaaaaccatggcctccttggggatggccagtgctcctggtgtctccacctgcctgggttgtgcaggaggccggctgccagtgcctggggctgggaaacttttttgcttggggcaggcttgggtgagctctcccagatgtgtgcccaccccaccactgcctggaacatccttgttctctgccaggatgcaggggcactgttgcctctgacacagcagtttctgggaactcagaggactgcctttctgaaggctggggagaggctttgagcaaggagcttgtttttgcttaatcgctctagaccatccctgatgcgtagatgtgagaggatgttttctggcacagtgttatgaaaatacaagataaatgatctcagtggaatgtttcatattacccgaaaaaaactggaaatcatcctttgttgtgaacacactgagactaagaattgaagcaatgcagttttaagaagtatttttcctattttttgctgtcaactttttggcaatgccacggcaaagttggtgtttcagcacatgctagagtgagctccggcttcgtgtctttaaccaactccactaatgtttcactgggtagacggagctggcctctatatttagccagaagcctttgcctcttttcaggcatcaaaaatgggttttgtcattgtctttgtctttgagagcagcagtttgaggtctgactccttcagttgtcctgtgagctgggcgttgcagtctgctcgaatcaagtgttggaaccccccccacccctcagcccatcgtgaaacgacagctgtcagcctggggggcggctgctgaggaggtgcagcaggaatggggctgggccctgaggttttactttccgagccaatggcccctggaacatgccagcacacactgccatgtcctggggctaagagctgcctttagggacaggctcgtgttgtccagtttgccctgagagatgcacctgaccaggggcccgtcgtggctgcaacccacggtggtatgttagtgtttccaggcagttgtcagcagctgccgggcagtgtgtgtgtgcgacagcaggagagttcctggaggaaagggactggggacactttctcagaggttctcctgcctggaatcaagtgatgcgtgtccagaaggcaagagagggcggctccgcctggttaaagtttgggaacgggacggagccaactcctccttccaggactgtgggccccactcttttgcgctaacacttcccctccctcgggtcactgaggaaagagctgctctgtcccctccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtgatgtgcaggcccacttcttaccccagatagcctcgggcgctgcctgtagtcatgctgacagctgtacagtagccgccaagactgctgacagctggagacggttctggtttcaactacggtatattgatatcggaagtattctagacagatcctcggttgggttttctagctacatgtttgtattgcacagatccccacctgccatcctatagtgttgtcttcctgtgtgttccggggcttctgggcagctgggcctgcccggggaagtccttgcaggtgggaggccatacagagacccactgtgtgccactgaacgtcccactgctgctgggcaactggaggactgcagggggcgccaggtgactctctccttttatatcacagcagctcctgtgctgaccttcaagttacgttttggaactgtaatactaaaggaagaaataaactactaatttgtataata

SEQ ID NO: 189562 - DNA, 6086 bp, Homo sapiens
  Payload ID: 17431
  Gene Symbol: TBC1D2B
  Gene Name: TBC1 domain family, member 2B
  Uniprot ID: Q9UPU7
  ENST ID: ENST00000409931
  CDS Start-End: 73-2817
gggggtagggggcgcagcggccgcggcgcggaggcgcagggcgcgggcgcctacggttggcgcgcggtagcgatgccgggggccggagcccgggcggaggagggcggcggcggcggcgagggcgcggcgcagggggcggccgcggagcccggggcgggtccggcgcgggagccagcgcggctgtgtggctatctgcagaagctgtcgggcaagggccccctgcgtggctaccgcagccgctggttcgtgttcgacgcgcgccgctgctacctttactatttcaagagtccgcaggacgcgctgcccctcggccacttggacatcgcggacgcctgcttcagctaccagggccccgacgaggcggcggagccgggcacggagccgcccgcgcacttccaggtgcacagcgcgggagccgtcacggtgctcaaggctcccaatcgtcaactcatgacttactggttacaggagcttcagcagaagagatgggaatattgtaacagtcttgacatggtcaagtgggacagcaggacctctccaactcccggggattttcctaagggtcttgtagccagagataacactgatttaatttacccacacccaaatgcttctgcagaaaaagccagaaatgtcctagctgtggagactgtgcctggagagctggtgggagaacaagctgcaaatcagcccgccccagggcatccaaattccattaatttttactctttgaaacagtggggcaatgagctcaagaattcgatgtcttctttccgtcctgggagaggacataatgatagtcggaggactgtgttttataccaatgaagagtgggaacttttagacccaacccctaaggacctagaggagtccatagtacaggaagaaaagaagaagctgacccctgaaggaaacaaaggagtaactggctcaggattcccctttgattttggacgtaacccctacaaaggaaagcgccctttgaaagacataattgggtcgtacaaaaatcgtcacagcagtggtgacccttcaagtgaaggcacatcaggcagtggcagcgtcagcatcaggaagccggcctccgaaatgcaactgcaggtccagagccagcaggaagagctggaacagttaaagaaagacctgtccagtcagaaggagcttgttcgactgctccagcagacagtccggtcatcccagtatgacaagtatttcacaagcagccggctctgtgagggggtcccaaaggacacgctcgagcttctgcaccaaaaggatgatcagattctgggccttaccagccagctggagaggttcagcttggagaaggagagtcttcagcaggaagtaaggacgctgaagagcaaagtgggcgagctcaacgagcagctgggaatgctcatggagaccatccaagccaaggacgaggtcatcatcaagctcagcgagggcgagggcaacgggcctcctcccaccgtggcgcccagctccccttcggttgtgcctgttgccagggaccagctggaactggacaggctgaaagataatctacaggggtacaaaacccaaaacaaatttctaaataaggagattttggaactctcagctctacgaagaaatgcagaaaggagagagagggatctgatggcaaagtattctagcctggaagccaagctctgccagatagaaagtaaatacctgatattgctccaagaaatgaagacaccagtgtgctcagaagaccaggggcccacccgggaggtcatagcccagttgctggaggatgctctgcaggttgagagccaagagcagccggagcaagcatttgttaaacctcatcttgtcagtgaatatgatatttatgggttcaggactgtacctgaggatgatgaggaagagaaattggttgccaaggtccgcgcgttggatctgaagactctctacctcacagaaaaccaggaagtctccactggggtcaagtgggaaaactattttgcaagtacagtgaacagggagatgatgtgctctccagagttaaaaaacctcatccgtgcgggcattccccacgagcaccgttccaaggtgtggaagtggtgtgtggaccgtcacaccaggaagttcaaggacaacactgagcctggccacttccagaccttgctgcagaaggcgctggagaaacagaacccagcctccaagcagattgagctggacttgctgcgaactctgcccaacaacaaacattactcctgccccacctcagaaggcatacagaagttacgcaatgtcctcctcgccttctcctggcggaatccagatatcggctactgtcaaggcctaaacaggttggtggcagtggccctcctgtacctggaacaagaagatgctttctggtgtctcgttaccatagtggaagttttcatgcctcgagactattatacaaagactcttttaggatcccaggtggaccagcgggtgttcagagaccttatgagtgagaagctgcctcggttgcatggccactttgaacagtacaaagtcgactacactctcatcactttcaactggtttctggtggtatttgtggatagtgtcgttagtgacatcctctttaaaatatgggactctttcctttatgaaggaccaaaggttattttccgttttgctctggcactttttaagtacaaggaagaggagattttgaaattgcaagattcgatgtctatatttaagtatctccgctacttcactcgcactatccttgatgctagatccggaaccgacgcgcctaccacttggagaaagtccggctggagctgaccgagctggaggccatccgtgaggacttcctgcgtgagcgggacaccagccctgacaagggtgagctggtcagtgacgaggaggaggatacctgagtgggctcgggatgctgctcttccttccttcacaaccaaagtgtgcccaaagggtgaaagtgcacttaaaagccagaatgtaacgtgtgtgtcctctggggatctgctgggcagatgtcccaagccaggctgcccttcctcatttcccactgtgcggggggcaggggtgggaggtctaatctgtttacaaccatttccgtgccatgcttttggttacacgtatctcagtcacgctttctgcctggttggtggatcctcaggcttaccagtggctatttgcaagagcctgtttccagcctccgtcagcctgtcggtgctctgaccctctgaaaccttgctttgctgggcatctccccatattctctctcctgtacatagtgggcagtggtgtgtggttttgaatggcagtgctataaaggatgccagctgtgctttaggcacctgtaggccagagggttgctgcctcaggcataaggttggtatgaaaaggggctgccttagaaaagcaggcacatcccttgttcagaaatggccactgtaggaaagcctgtgaacctcccaccagtggctttaagctgccagccatgccccatttctagaatagcctttgctcttccacacgcaacccttccatcagtgtcttccagcctgcatggggagggcctggctgcccagacacccaccctcacttctcatggccagcctgtgtttgcagatcactgggctgctctgtccccagcttgccccgtgccaggcatggctctgtgagattctgtggaatgcccttcttgacttgtggaaatcattcaccaagtacgatgggatgggattccaagtaaacagtggaccgtcatattgcaaagcaggcccacgcctgggctggccttggttgaggggatggaggaatgttttcgggggtgctttgcagggcagtggtgcagccgcagcgtgaacgctcttggacagctgaaaaccatggcctccttggggatggccagtgctcctggtgtctccacctgcctgggttgtgcaggaggccggctgccagtgcctggggctgggaaacttttttgcttggggcaggcttgggtgagctctcccagatgtgtgcccaccccaccactgcctggaacatccttgttctctgccaggatgcaggggcactgttgcctctgacacagcagtttctgggaactcagaggactgcctttctgaaggctggggagaggctttgagcaaggagcttgtttttgcttaatcgctctagaccatccctgatgcgtagatgtgagaggatgttttctggcacagtgttatgaaaatacaagataaatgatctcagtggaatgtttcatattacccgaaaaaaactggaaatcatcctttgttgtgaacacactgagactaagaattgaagcaatgcagttttaagaagtatttttcctattttttgctgtcaactttttggcaatgccacggcaaagttggtgtttcagcacatgctagagtgagctccggcttcgtgtctttaaccaactccactaatgtttcactgggtagacggagctggcctctatatttagccagaagcctttgcctcttttcaggcatcaaaaatgggttttgtcattgtctttgtctttgagagcagcagtttgaggtctgactccttcagttgtcctgtgagctgggcgttgcagtctgctcgaatcaagtgttggaaccccccccacccctcagcccatcgtgaaacgacagctgtcagcctggggggcggctgctgaggaggtgcagcaggaatggggctgggccctgaggttttactttccgagccaatggcccctggaacatgccagcacacactgccatgtcctggggctaagagctgcctttagggacaggctcgtgttgtccagtttgccctgagagatgcacctgaccaggggcccgtcgtggctgcaacccacggtggtatgttagtgtttccaggcagttgtcagcagctgccgggcagtgtgtgtgtgcgacagcaggagagttcctggaggaaagggactggggacactttctcagaggttctcctgcctggaatcaagtgatgcgtgtccagaaggcaagagagggcggctccgcctggttaaagtttgggaacgggacggagccaactcctccttccaggactgtgggccccactcttttgcgctaacacttcccctccctcgggtcactgaggaaagagctgctctgtcccctccagtgccctgaaggtccctggcctccactggctgccatggcagggggcccttctgacaggggctgccccaagctgctgttcctcctctgaaccttcaccccaacacccagcccgtggcccctgcaagggggaccctgccagctgggaaacccaaaggcctgtccaaacgtgcgcaccaggaccgaggggagctccctcccaacacctgctaggaattgccaacttttaaatggatggggttttttatgggttgaacctctgttaatacttttgtacactctcactacagtttatatttttataggctattttctcaaggtgtttctagattccacatatctattttatataacaagttattatgttatgtgtgtgactcccttgtgtgtatctgtgccagcctcagcctccgagttgcttttccctctggccctgactctcactgactcaccgatgtgatgtgcaggcccacttcttaccccagatagcctcgggcgctgcctgtagtcatgctgacagctgtacagtagccgccaagactgctgacagctggagacggttctggtttcaactacggtatattgatatcggaagtattctagacagatcctcggttgggttttctagctacatgtttgtattgcacagatccccacctgccatcctatagtgttgtcttcctgtgtgttccggggcttctgggcagctgggcctgcccggggaagtccttgcaggtgggaggccatacagagacccactgtgtgccactgaacgtcccactgctgctgggcaactggaggactgcagggggcgccaggtgactctctccttttatatcacagcagctcctgtgctgaccttcaagttacgttttggaactgtaatactaaaggaagaaataaactactaatttgtataat

SEQ ID NO: 189563 - DNA, 948 bp, Homo sapiens
  Payload ID: 17431
  Gene Symbol: TBC1D2B
  Gene Name: TBC1 domain family, member 2B
  ENST ID: ENST00000435468
  CDS Start-End: 75-948
cattcagagggaggctccaggagggaacagtgttcacttggcatctttcggtatttctgggagggtgaattgcaatgatcaccaccaccaaagagctggctcccaatcgtcaactcatgacttactggttacaggagcttcagcagaagagatgggaatattgtaacagtcttgacatggtcaagtgggacagcaggacctctccaactcccggggattttcctaagggtcttgtagccagagataacactgatttaatttacccacacccaaatgcttctgcagaaaaagccagaaatgtcctagctgtggagactgtgcctggagagctggtgggagaacaagctgcaaatcagcccgccccagggcatccaaattccattaatttttactctttgaaacagtggggcaatgagctcaagaattcgatgtcttctttccgtcctgggagaggacataatgatagtcggaggactgtgttttataccaatgaagagtgggaacttttagacccaacccctaaggacctagaggagtccatagtacaggaagaaaagaagaagctgacccctgaaggaaacaaaggagtaactggctcaggattcccctttgattttggacgtaacccctacaaaggaaagcgccctttgaaagacataattgggtcgtacaaaaatcgtcacagcagtggtgacccttcaagtgaaggcacatcaggcagtggcagcgtcagcatcaggaagccggcctccgaaatgcaactgcaggtccagagccagcaggaagagctggaacagttaaagaaagacctgtccagtcagaaggagcttgttcgactgctccagcagacagtccggtcatcccagtatgacaagtatttcacaagcagccggctctgtgagggggtcccaaaggacacgctcgagcttctgcaccaaaaggatgatc

SEQ ID NO: 189564 - DNA, 547 bp, Homo sapiens
  Payload ID: 17431
  Gene Symbol: TBC1D2B
  Gene Name: TBC1 domain family, member 2B
  ENST ID: ENST00000465531
  CDS Start-End: 1-368
attgcaagattcgatgtctatatttaagtatctccgctacttcactcgcactatccttgatgctaggtcctgcctgccgctctgagcagtacacactctgcctctgcacacctaggggccatggggctcagcctgggactggcacccaggtgcccaccgcccaagacccaaagacactctctctgccagaacagcaccttactgcctgtgtcaggatgaaggcagacctccaccgtcacctcctcgctgtcctcctggttctcatacacccccttttctcctatgtagcctcccctctggctgtgcctggaggggtggcagagtgtggagttttagtgggttgggtgcccagaccctctgcttcctagctgaaaccatgggcagctcatttggcctctctgaacctcagtgtcctcctctgtgaagtgggagcaacaatcctgcctcctccaagccctggagggaggactgcatgtgttcttgcatgtgtaggctcggcccttgcccggcacatcctaagagctcgatccatgccagctgctgctag

SEQ ID NO: 189565 - DNA, 2063 bp, Homo sapiens
  Payload ID: 17432
  Gene Symbol: TBC1D3
  Gene Name: TBC1 domain family, member 3
  Uniprot ID: Q8IZP1
  ENST ID: ENST00000620215
  CDS Start-End: 99-1748
gttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtacaacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcaggcagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatga

SEQ ID NO: 189566 - DNA, 582 bp, Homo sapiens
  Payload ID: 17433
  Gene Symbol: TBC1D30
  Gene Name: TBC1 domain family, member 30
  ENST ID: ENST00000544457
  CDS Start-End: 214-582
gcagatgcctgctggcttccctgcgctcggcggctcccgcggtgccccgtaagtccccgtgaccctccagcaccagccggctgtgcgctccctgctcccacgggccggtcagccgcagacactcacccagctccgcgagctcagccgctcagcgagtggggtagcggggaccgagacggacggtagccgtgccagagcccggggcgctctcggatgcggcaggacaagctgaccgggtctctgaggcgcggggggagatgcctgaagcggcagggcggcggcgtgggcaccatcctgagcaatgtgctcaagaagcgcagctgcatttcccggaccgcgccccggctgctgtgcaccctggagccgggagttgataccaagttgaaattcactcttgagccatctttaggtcaaaatggttttcagcagtggtacgatgctctcaaggcagttgccaggctatccacaggaataccaaaggaatggaggagaaaggaccttcaccgcacaggctgtagttcttactgtggccaggaggctgagcaggacagggttgtgttgaagcgggtgctgctggcctat

SEQ ID NO: 189567 - DNA, 2594 bp, Homo sapiens
  Payload ID: 17433
  Gene Symbol: TBC1D30
  Gene Name: TBC1 domain family, member 30
  Uniprot ID: Q9Y2I9
  ENST ID: ENST00000539867
  CDS Start-End: 309-2594
acgccgcctccgtctcccacgcgctcgctcgctcgctcgctcccgccctccccgcctcgagcgatctcctgcctcagccttgcaggctccgcactgcagatgcctgctggcttccctgcgctcggcggctcccgcggtgccccgtaagtccccgtgaccctccagcaccagccggctgtgcgctccctgctcccacgggccggtcagccgcagacactcacccagctccgcgagctcagccgctcagcgagtggggtagcggggaccgagacggacggtagccgtgccagagcccggggcgctctcggatgcggcaggacaagctgaccgggtctctgaggcgcggggggagatgcctgaagcggcagggcggcggcgtgggcaccatcctgagcaatgtgctcaagaagcgcagctgcatttcccggaccgcgccccggctgctgtgcaccctggagccgggagttgataccaagttgaaattcactcttgagccatctttaggtcaaaatggttttcagcagtggtacgatgctctcaaggcagttgccaggctatccacaggaataccaaaggaatggaggagaaaggtttggttgaccttggcagatcattatttgcacagtatagccattgactgggacaaaaccatgcgcttcactttcaatgaaaggagtaatcctgatgatgactccatgggaattcagatagtcaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgataaggtacttcccgaaagctatttcgtcaataatctccgggcattgtctgtggatatggctgtcttcagagaccttttaagaatgaagctgccggaattatctcagcacctggatactcttcagagaactgcaaacaaagaaagtggaggtggatatgagcccccacttacaaatgtcttcacgatgcagtggtttctgactctctttgccacatgcctccctaatcagaccgttttaaagatctgggattcagtcttctttgaaggttcagaaatcatcctaagggtgtcgctggctatctgggcaaaattaggagagcagatagaatgttgtgaaacagcagatgaattctacagcaccatggggcgccttacccaggagatgctagagaatgatcttctgcaaagccatgaactcatgcagactgtttattccatggctccgttccctttcccacaattggcagagttgagggaaaaatacacctacaacattacaccgttcccagccacagttaaacccacctcagtttctggacgacatagtaaggccagagacagtgatgaagagaatgacccagacgatgaggatgctgtcgttaatgcagtggggtgtcttggaccttttagtgggttcctggctcctgaactgcagaagtaccaaaaacaaattaaagagccaaatgaggagcagagtctgagatctaataacattgcagagctgagtccaggagcaatcaattcctgtcgaagtgaataccatgcagcttttaacagtatgatgatggaacgcatgaccacagatatcaatgcactgaagcggcagtactctcgaattaaaaagaagcaacagcagcaggttcatcaggtgtacatcagggcagacaaagggccagtgaccagcattctcccgtctcaggtaaacagttctccagttataaaccaccttcttttaggaaagaagatgaaaatgactaacagagctgccaagaatgctgtcatccacatccctggtcacacaggagggaaaatatctcctgtcccctacgaagaccttaagacgaagctcaactccccgtggcgaactcacatccgagtccacaaaaagaacatgccaaggaccaagagtcatccgggctgtggggacaccgtagggctgatagatgagcagaacgaggccagcaagaccaatgggctgggggcagcagaggcattcccctctggttgtacagcgacagctgggagagaaggcagcagccctgaaggcagtaccaggaggacgatcgaggggcagtctccggagccggtgttcggagatgctgatgtggatgtgtctgcagttcaggcgaagttgggagccctggaactgaaccagagggatgctgcagctgaaactgagctcagggtgcacccaccctgccagcggcactgcccagagccgccgagtgcacccgaagaaaacaaagccaccagcaaagctccccaaggcagcaactcaaaaacccccatctttagcccttttcccagcgtcaagcccctgcggaaatctgctactgccaggaacttgggattatatggccctacagaaagaaccccaactgtgcactttcctcaaatgagtaggagcttcagcaaacccggcggtggaaacagtggcactaaaaaacgatga

SEQ ID NO: 189568 - DNA, 7433 bp, Homo sapiens
  Payload ID: 17433
  Gene Symbol: TBC1D30
  Gene Name: TBC1 domain family, member 30
  ENST ID: ENST00000542120
  CDS Start-End: 246-2189
gactgcctgcttgcaggctgtgtcacagaagagaacatggcagaacagtatgctcaggagttgataccaagttgaaattcactcttgagccatctttaggtcaaaatggttttcagcagtggtacgatgctctcaaggcagttgccaggctatccacaggaataccaaaggaatggaggagaaaggtttggttgaccttggcagatcattatttgcacagtatagccattgactgggacaaaaccatgcgcttcactttcaatgaaaggagtaatcctgatgatgactccatgggaattcagatagtcaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgataaggtacttcccgaaagctatttcgtcaataatctccgggcattgtctgtggatatggctgtcttcagagaccttttaagaatgaagctgccggaattatctcagcacctggatactcttcagagaactgcaaacaaagaaagtggaggtggatatgagcccccacttacaaatgtcttcacgatgcagtggtttctgactctctttgccacatgcctccctaatcagaccgttttaaagatctgggattcagtcttctttgaaggttcagaaatcatcctaagggtgtcgctggctatctgggcaaaattaggagagcagatagaatgttgtgaaacagcagatgaattctacagcaccatggggcgccttacccaggagatgctagagaatgatcttctgcaaagccatgaactcatgcagactgtttattccatggctccgttccctttcccacaattggcagagttgagggaaaaatacacctacaacattacaccgttcccagccacagttaaacccacctcagtttctggacgacatagtaaggccagagacagtgatgaagagaatgacccagacgatgaggatgctgtcgttaatgcagtggggtgtcttggaccttttagtgggttcctggctcctgaactgcagaagtaccaaaaacaaattaaagagccaaatgaggagcagagtctgagatctaataacattgcagagctgagtccaggagcaatcaattcctgtcgaagtgaataccatgcagcttttaacagtatgatgatggaacgcatgaccacagatatcaatgcactgaagcggcagtactctcgaattaaaaagaagcaacagcagcaggttcatcaggtgtacatcagggcagacaaagggccagtgaccagcattctcccgtctcaggtaaacagttctccagttataaaccaccttcttttaggaaagaagatgaaaatgactaacagagctgccaagaatgctgtcatccacatccctggtcacacaggagggaaaatatctcctgtcccctacgaagaccttaagacgaagctcaactccccgtggcgaactcacatccgagtccacaaaaagaacatgccaaggaccaagagtcatccgggctgtggggacaccgtagggctgatagatgagcagaacgaggccagcaagaccaatgggctgggggcagcagaggcattcccctctggttgtacagcgacagctgggagagaaggcagcagccctgaaggcagtaccaggaggacgatcgaggggcagtctccggagccggtgttcggagatgctgatgtggatgtgtctgcagttcaggcgaagttgggagccctggaactgaaccagagggatgctgcagctgaaactgagctcagggtgcacccaccctgccagcggcactgcccagagccgccgagtgcacccgaagaaaacaaagccaccagcaaagctccccaaggcagcaactcaaaaacccccatctttagcccttttcccagcgtcaagcccctgcggaaatctgctactgccaggaacttgggattatatggccctacagaaagaaccccaactgtgcactttcctcaaatgagtaggagcttcagcaaacccggcggtggaaacagtggcactaaaaaacgatgatgtctccccgaaactttgtatctggactcaccttttcacagtagtataagggttgcagctgaatggctctaaaagagttttatttgtccagtgaaaatgaataggttcagggatgagcaacagcccataaaaaatgggaactggaagttttataataggagttagaacagggctgttttcccagctacttgctaactgacgaagtggattcttgtggcaaaataaatattgtggttttatagtgtgaagttttcccaatttttcattgtgagctgtttaaaaaagactatatctagattgttaactctcgtccatccttctgttctgggggccttcagagtccctgtgacagcacccccaaaccttccagttctctgggtgttactaatactcaagcatgcacataccagcttgctaggacagaaactgtaaaaagaaagtaagtttcttcgttacaaaaaacttcctgattttccttttcatgctttacggaggggattgtgtcgtgtgagatttcccacagtaccagtttcaaattttttttttattcttatgctaaatcataggagaaaaatctagatagcctttctttaactgtctatttctacctgcaaaatgaagaaaacctttcatctgttgaaatttcaatcgataacccagctgaagatcttatgcacaggacacacttggcatatgctttacgcagttgctccggacagcttgctcgcgccactgagcttttcctgaggtttgtgttcgcctctcaaggagagctttgatcctcagtggtacggatgacttgatgggctccatgcggagcctggcctgcatcccccaccacacagctcactcacccaccagctctagactgcagacgcacaaggcctctgctcagaagccagaacacagcacctgtgactctgttacttgaattttgtgctttttgattggagtcctttgttgagtactttgttaattgaacactgcctttctctggagaaggccccagtgctttctagctccctctcactcctgccctttctagctctctctcacccagcgggtcagggatagcacctcttgtctccactatgcagatgggaactctgagccacacagaggtgaagtagcacttcagttactcaaggtcagtactctcggtattccaagtgacttagccacatttccttcagtgcaataggtgggtttaatgctctttgtacacagatgtattggctacatagcgtgtaaaaaccaagactgggaagccattcactaaaatccctcctgactcaaaggacctgtctccagatggtacagagtcccttgatggcattttacaaaaccagctctgacttccttatcctgaacagggagtttattttaaaaatgcttcatgcacctgttatttggctgaacagaaggctcactcctcaatccccttctcctcgccatcattagaggaatagactcagccttcatgtttgtctctggaagacgattggcgatacttgcaggaatattgttgatgcagccaatattaatttgagctaatggattgttaattctgaaacgaaaactgtaactgtagagcaggcttttactatgagaggtactactttttataatagagaatgtggttgtgtgggctttttttgaacagaaaacacaacaatgacctataccgtgagaaaagccattttatcttcttcgtggtatttttacccccaaaggaactgaagatggaaaatatgactaataagttattgcagttttggtcttgaattctgtgccatctgaagttagcatccagcttcttaaaaagcagccacgcctacagcctgttttttgggaaggctgtaggtggagagatgggcttattttgcataccaccctcagggcccagagacccactgcattttccaaagttaagcaaatgacaccattttcttccatcagctaaactttacagataatagtgtttccacctcatatccttttctttgccccttctcaaatgagtcagaatagtcatgttccccttgagggatgtctgacttgaatggagaattgttctttcctctcttgaatcagctcactagctccctgatggtctgggttcaaggaaatggttaatgaggtagaggccacttatacaagtccttgggattgtaccattgctgtccacaaacttagtatcaacaacacatgctgtgccctgtgaacactctcctctcacctatttccagggttggtcttcctgagaaggggatggatgaggtaacacacagtttgggatacgtatctgttgaatgaatgaataagtgaaaggataatagtcctctgaggtaaaaatggccttgtcagaattttgaaaatccaacagattcctattaaagcactctgtgtaccaataacatgcatgcattgtaccaagtaatcacaatgtgaattggtcaatttatgagccttgcctactttagaaaataaagaaacctgcagtagcctctaccacacagcatgtacaaagaccagtatggacttgctatcttccctatgtattggacactgtatgcaaacaccagaagtacttaacaagtagtggtttcttgatttttagatatgtctgtagcctcttagcccttttgccgggaatcaactcattctgatgcctctgcacctcagttcctcttacaaaagcctccagatgatctaaatctagttagcaatgtcagcctgtggactgcagctgtttgggacattgtattcctttgtttgtctcttgttgttctgaaggattgtattgatcacaaagctatatgcataaagattctcattgttgtaactgttctgccattttctgagtgcaagcatggaacactgttgtgacagtcccttctcccttcttccttcttccttcacccccaaccccagaccccccttggtcacatgaaccagggaaacagcccaataagctctatctcccccagtctaatcgctgggttgcagggtggcctgtgacctgcccagcatttgcagactcgctggttcctgaatatgagtaagcacagagtttacctagagagtttacctaaaattaacctttagatctactatttatttttgtcttaataaaatgaacaataaatatagtttagctgcatggcattaaggattctgtatgaatagatgtatagttgctgccatctccccatataaaaactctctttacatcgtttctgagccactttctttgctgtctgcagcatttaaaatatattatttttcctaattagaaaagtcacaggttttagaaaattgggaaaacaaaaagagcataaagaatcatcaatactctgatatagatatagatctttccagtacgtttgtgtatgtgtgtacacgccattatctacaaaaaagttatgttgaacatggtagtttaagctgtctttctggtaaatgctcttatacaatatgatttttagtgactaatattccctaatgtgttcatgccagaattcacataaccagtaccttgtcaaataggaggtttctgattagatagtagtagagacagtatcctgttacatgtatgtacatagcccgaattattttcttaggatatgcgtatagaagtggagttgaagggtcaggaaatatgtccatttttaagatacatatatctccaaattgccattcttaaaggttggagttatacaagtagtgaatgagaatgcctgcttctctacatcctggaagaggcagcagtctctttccttttttttcctttctatgacttctagtgtggaagtgccaacagaagtgttttagaagcagtgataatgaacactcataacacccatacctcattcctgacttttaaaagaagcattaagtaagatgttgaggtttctggtaggtgcctattattaggttaagaaaattcccttttattctttgcttgctaagagttttcttcatcaacaggtattgaatttcataaaaagaactttaattgtatcttttgagaagggaatagtacttgagacttggtatcctgaactcaaagaaatagccattactaggttttgtcaaagaataccagatattttagagttggaagttatgcagtaaaagctttatgtgcaaatgttcattgaagtattaaatgtactaatggaaacctgaaaacaatataaacatctgggaataggggagatgtttggatgaattatgattcatccccaggatggaaatgtgaaggccggtgagtatttggaccattgaagtgggagttatctgttatccacatcaggcagctcagagtaaagtcagcaagtctacagtcatagagccaccaggatacagtgatggatgggaggcctttgctggacagtggctgaaggcagaactgttggagtggttcttccacaaaggcagccagtgctcacctgaatggggactggtactgtaggtattgggtcagctttcatgccgttccctgctggccatctcccaatgctgaatgtctgactcagttcaggctgctgtaacaaagtaccatagactgaggtggcttaaacacagacatttctttctcacagttctggaggctgagaagtcaaagatcaacgtgtctgcaaatttggtatctggtgaggaagggccctcttcctggtttgcagatggctaccttctcactgtgtcctcacacaatggagaaagggagtatgttttggtctcttcctcttctgataagggcactaacctcatcatgagggtcccatcctcctggtgtcatctaaacctaattacctcccaatggccccgccttcaaataccatcacgttgaaggttgcttccttcctggtcgtttgctctggtgagaccaaatgacctgcaaagtgtcacttgattccattctctccatcccttccatcccaggcaatctttatctagctacaccaacctgtgccccaggggcttcaagagttgttgttgttttaacattaaaaaaccagaaagttcacttgtttcttagtgtttacatccttgctataacaattctagttttcctttaggcaatgctgatcactgggaaggaggtggatcaattctcctatgggaccaacagttttctgggaagaaacttcctgatacctcagcctaggaatctccctatccctggagagtccaggaatctatattaaaacatgaaacaaagcaaaaaataaaaaaaaa

SEQ ID NO: 189569 - DNA, 510 bp, Homo sapiens
  Payload ID: 17433
  Gene Symbol: TBC1D30
  Gene Name: TBC1 domain family, member 30
  ENST ID: ENST00000544190
  CDS Start-End: 72-510
gcggccgcagcggtgccggcgactcccgcgtgctgcaggagctgcaggagcgaccgagccagcggcatcagatgctgtacctgcggcagaaagacgctaatgaactgaagacgatccttcgagagctaaagtacagaattggcatccagtcggccaagttacttcggcatctgaagcagaaagataggcttctgcataaagtgcagaggaactgtgatattgtgactgcctgcttgcaggctgtgtcacagaagagaagagttgataccaagttgaaattcactcttgagccatctttaggtcaaaatggttttcagcagtggtacgatgctctcaaggcagttgccaggctatccacaggaataccaaaggaatggaggagaaaggtttggttgaccttggcagatcattatttgcacagtatagccattgactgggacaaaaccatgcgcttcactttcaatgaaaggagtaatcctgatgatgactccatgggaattcagatagtca

SEQ ID NO: 189570 - DNA, 721 bp, Homo sapiens
  Payload ID: 17433
  Gene Symbol: TBC1D30
  Gene Name: TBC1 domain family, member 30
  ENST ID: ENST00000539120
  CDS Start-End: 448-721
gatgcctgctggcttccctgcgctcggcggctcccgcggtgccccgctcgcaggaagccagaccttgcgagaggtgtgtgggggcggagagtggcacaggtttgacactgcaggtcggaggaggaagacagtggctgcaaaggcaaaatcgggtgttattttcccaagagtcccttcagcgtgagtgccggggtcagctcgaactggagcctgtaatttgtgagtgcgagtggggagcagcaggagatccttttcataggagttgataccaagttgaaattcactcttgagccatctttaggtcaaaatggttttcagcagtggtacgatgctctcaaggcagttgccaggctatccacaggaataccaaaggaatggaggagaaaggtttggttgaccttggcagatcattatttgcacagtatagccattgactgggacaaaaccatgcgcttcactttcaatgaaaggagtaatcctgatgatgactccatgggaattcagatagtcaaggaccttcaccgcacaggctgtagttcttactgtggccaggaggctgagcaggacagggttgtgttgaagcgggtgctgctggcctatgcccgatggaacaaaactgttgggtactgccaaggctttaacatcctggctgcactaattctggaagtgatggaaggcaatgaaggggatgccctgaaaattatgatttaccttattgata

SEQ ID NO: 189571 - DNA, 3502 bp, Homo sapiens
  Payload ID: 17434
  Gene Symbol: TBC1D31
  Gene Name: TBC1 domain family, member 31
  Uniprot ID: Q96DN5
  ENST ID: ENST00000287380
  CDS Start-End: 91-3291
aaatttcccgggccgggagcgctgggcctgccgggaaggcgctgggacggttacccagcgggccgccggcggtcgtgggcaagcttcgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggttcaatcttgttcagcgaacagcacaagcttgcacagctctggcctttaatcttcgtaggaaatctgaattccttgtggcattagctgattattctattaaatgttttgatacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggcagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaaggtatatatgagagatcgagaaattgctgccacagccagagacctagaaatgagacagctggaactcgaatcacaaaagagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaaggtgattaaagaaaatttggcaaaggctgaacaagcatgcctaaataccgactggcagattcagtctttacataaacaaaaatgtgatgatctacaacgaaacaaatgttaccaggaagtagccaaactccttagggaaaacagaaggaaagaaatagagataataaatgcaatggtggaggaggaagccaagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgtt

SEQ ID NO: 189572 - DNA, 2985 bp, Homo sapiens
  Payload ID: 17434
  Gene Symbol: TBC1D31
  Gene Name: TBC1 domain family, member 31
  Uniprot ID: Q96DN5
  ENST ID: ENST00000327098
  CDS Start-End: 58-2970
ggaaggcgctgggacggttacccagcgggccgccggcggtcgtgggcaagcttcgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggttcaatcttgttcagcgaacagcacaagcttgcacagctctggcctttaatcttcgtaggaaatctgaattccttgtggcattagctgattattctattaaatgttttgatacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggcagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcacctt

SEQ ID NO: 189573 - DNA, 605 bp, Homo sapiens
  Payload ID: 17434
  Gene Symbol: TBC1D31
  Gene Name: TBC1 domain family, member 31
  ENST ID: ENST00000518684
  CDS Start-End: 401-605
gtcaggcaatctgtgagaatctgaaaggaagttgctctaaaataaattttttacgtgtgatttatatgaaaaatcggaggggcagaatgtcactattgtgattacatctacatgaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggttcaatcttgttcagcgaacagcacaagcttgcacagctctggcctttaatcttcgtaggaaatctgaattccttgtggcattagctgattattctattaaatgttttgatacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagata

SEQ ID NO: 189574 - DNA, 653 bp, Homo sapiens
  Payload ID: 17434
  Gene Symbol: TBC1D31
  Gene Name: TBC1 domain family, member 31
  ENST ID: ENST00000520368
  CDS Start-End: 521-653
acctgaaagcgataaaggaaggcttcgggccagaggaagaggtaggccgggctgatgaggccgagtttgccgaccaagggcacggcgacggtggcggcgaaccaatagcgcgtgatcgccgggatgctcctgaaccagtctccgatgtccgacatcttcgacccacaggtagccaagatgcacaagaccgcccgactccccgtgccgaccccctcacgacgcggccggctccgcgactgttaggtgtctaggtggaagccgccgaagccgcgatgcagaaggcggagacgggcggacgtggcgccaccgaattcggaccagcgaggcagccttctgaggcgaaacttccccttccggcgaccgcggacgacgtgaccagaagtcccgccgcttaaaggaattatagtgaacattattcacaacacttccgattaccatccaaaagttttgcgatttttgaatgtggcttttgatggcacaggcgactgcttaattgctggggaccaccaaggaaatatttatgtttttgacttacatggaaacagtcaccaaggagctagttagctggatgagaggacatgaatcatcagtattttcgatctctgtgcatgcatcagggaaatatgccatcacaacttcttctgatacagcac

SEQ ID NO: 189575 - DNA, 879 bp, Homo sapiens
  Payload ID: 17434
  Gene Symbol: TBC1D31
  Gene Name: TBC1 domain family, member 31
  ENST ID: ENST00000522276
  CDS Start-End: 137-879
acaattctgcctcttccaaaggctgcagtttatccatccttaaatccttggatgtgtttagacgcacaagcattcatcaactatttgttgagctcctactgtgtgccaagcacgcctctaagcgctggggacggcgatggaacaaaacacacttccggttctctggagtttacatatcggcgtaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggttcaatcttgttcagcgaacagcacaagcttgcacagctctggcctttaatcttcgtaggaaatctgaattccttgtggcattagctgattattctattaaatgttttgatacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagt

SEQ ID NO: 189576 - DNA, 3167 bp, Homo sapiens
  Payload ID: 17434
  Gene Symbol: TBC1D31
  Gene Name: TBC1 domain family, member 31
  ENST ID: ENST00000522420
  CDS Start-End: 257-3142
ggaaggcgctgggacggttacccagcgggccgccggcggtcgtgggcaagcttcgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgatggcacaggcgactgcttaattgctggggaccaccaaggaaatatttatgtttttgacttacatggaaacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggcagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaaggtatatatgagagatcgagaaattgctgccacagccagagacctagaaatgagacagctggaactcgaatcacaaaagagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaaggtgattaaagaaaatttggcaaaggctgaacaagcatgcctaaataccgactggcagattcagtctttacataaacaaaaatgtgatgatctacaacgaaacaaatgttaccaggaagtagccaaactccttagggaaaacagaaggaaagaaatagagataataaatgcaatggtggaggaggaagccaagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcg

SEQ ID NO: 189577 - DNA, 2201 bp, Homo sapiens
  Payload ID: 17434
  Gene Symbol: TBC1D31
  Gene Name: TBC1 domain family, member 31
  ENST ID: ENST00000518805
  CDS Start-End: 125-1987
aaatggaagtctaaacatatattcagttcaggctttaacacaagaaataaataagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaaggtatatatgagagatcgagaaattgctgccacagccagagacctagaaatgagacagctggaactcgaatcacaaaagagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaaggtgattaaagaaaatttggcaaaggctgaacaagcatgcctaaataccgactggcagattcagtctttacataaacaaaaatgtgatgatctacaacgaaacaaatgttaccaggaagtagccaaactccttagggaaaacagaaggaaagaaatagagataataaatgcaatggtggaggaggaagccaagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgttaaa

SEQ ID NO: 189578 - DNA, 3256 bp, Homo sapiens
  Payload ID: 17434
  Gene Symbol: TBC1D31
  Gene Name: TBC1 domain family, member 31
  ENST ID: ENST00000521676
  CDS Start-End: 211-3042
caagcttcgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgatggcacaggcgactgcttaattgctggggaccaccaaggaaatatttatgtttttgacttacatggaaacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagtaccctcatagataaggggactcatgtggcatttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggcagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaaggtatatatgagagatcgagaaattgctgccacagccagagacctagaaatgagacagctggaactcgaatcacaaaagagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaaggtgattaaagaaaatttggcaaaggctgaacaagcatgcctaaataccgactggcagattcagtctttacataaacaaaaatgtgatgatctacaacgaaacaaatgttaccaggaagtagccaaactccttagggaaaacagaaggaaagaaatagagataataaatgcaatggtggaggaggaagccaagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgttaaa

SEQ ID NO: 189579 - DNA, 569 bp, Homo sapiens
  Payload ID: 17434
  Gene Symbol: TBC1D31
  Gene Name: TBC1 domain family, member 31
  ENST ID: ENST00000519418
  CDS Start-End: 130-569
atttcccgggccgggagcgctgggcctgccgggaaggcgctgggacggttacccagcgggccgccggcggtcgtgggcaagcttcgccatgcagagcactgacctaggcaacaaggagagcggcaagatatggcaccgcaagccgtccccggccacgcgggacggccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagag

SEQ ID NO: 189580 - DNA, 864 bp, Homo sapiens
  Payload ID: 17434
  Gene Symbol: TBC1D31
  Gene Name: TBC1 domain family, member 31
  ENST ID: ENST00000518577
  CDS Start-End: 1-235
attaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagagtcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggcagacagttgaagatatgcaagctaaagtcgaccagcaaagagttgaagatgaagcttggtaccagaaacaggagctgcttcgtaaagctgaagaaacaagaagag

SEQ ID NO: 189581 - DNA, 2398 bp, Homo sapiens
  Payload ID: 17434
  Gene Symbol: TBC1D31
  Gene Name: TBC1 domain family, member 31
  ENST ID: ENST00000521914
  CDS Start-End: 1-467
gtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataaggaagaagttcgtgctcaaaattaatcacacagcgagtaactagcagttctgggtgttccaattcttccaagattacatgagattgggtgcatttggagtggcgtttgccacctttttttattctaaaaaaaagtttgtgcctcctcctttttgttttatcttttaaaaaattatacaagtagtgtcttattgcagaaaaaaataagaatgtacagaatagcaaacagacaaatacaaatcactgaaagtctcaccattctcagaagattctgatttatatgttcccaatttcttttctatgtgtgtaaatatatatagtcactcctcattatttgtgcattctatacatgagaattcacctgctcactaaaatttatttgtaacttcaaaattaatagttgcagtgctttcatggtcattcagggacatgcacagagcagtgaaaatttgagtcaccagataccctttttcccagctgaagtcaaatgaggcaacactctgtcttcttatttcagctctcatagtgtaaacaagtatcctttttgtgatctacttaataccatttatttttttgcattttgaagctttttgttaagattctactgcttaaagtggtccccaagcgtagcgctgaagcgctatttattgtttctaaatacaggaaggctgtggcttaccttacagagaaaatacatgtgttaaataaactcattcaggaatgagttatagtgctaagctgtgagttcaatgataaggaatcagcaatgtgtattaaataagatgtctttaaacagaaacacacatatatgtattgattgattaatgaggctctcaggaacctgactctgtgtttcccctaggagcagtgtttcagtattcactaatcgagtgttcatggtgactttatagaaccactgcaaatagtgagaattaactatacatatatgtttctgtgtgtacgcacatgtgtgtgtatgcatacttgtctctaaacatatgggattatactctgctgctgttttgctctttatgtcattatgtatactatataagtatatttttacattataatatgtgctatatattaataaatttttttaaatgtattaatatctgctcttactgagagagttttcagcctgctgaatagtcagttttacagtactagctaaaccttcttttctttttttttttgagatggagtctcactctgtcttccaggctggagtgcagtggtgtgatcttggctcactgcagcctccgcctcccgagttcaaacaattctcctgcctcagcctccctagcagctgggattacaggcgcgtgccaccacgcccagctaatttttgtacttttagtagagatggtgtttcaccatgttggccaggctgctcttgaactcctgaccttggtgatccacccgccttggcctcccaaagtgctgggattacaggcatgagccaccgtgtccagccttgcaaaccttcttaatagaggcaggcagagagctgagaaaaactatggtaagaatgagtcattgagttcctttctgcttgttatctgttgagcaaattgatatcacatgaatagaaaagctagcttggaagtagaatgatcttttttattttttgacacattcccagtaccatcagtgtctttatggctgttccaggctacattaatgttcaattctatattctctataaatcataactcacctttgtctcatttttaccagttttattttcttgtcattggagaatttctggtattgtggtaatagagtaaatgaattcttaagtgttgaaggtttaacactacaaaggtatgtcaagtcaggttgtttctcaggttcttttttgggaggttatacttcatggtagaggataaggctcaaacgggaaattgtgacattttaataaattttaattttaataaaattttagtaaatttca

SEQ ID NO: 189582 - DNA, 3101 bp, Homo sapiens
  Payload ID: 17434
  Gene Symbol: TBC1D31
  Gene Name: TBC1 domain family, member 31
  ENST ID: ENST00000524307
  CDS Start-End: 5-247
cgccatgcagagcactgacctaggcaacaaggagagcggcaagatatggcaccgcaagccgtccccggccacgcgggacggaattatagtgaacattattcacaacacttccgattaccatccaaaagttttgcgatttttgaatgtggcttttgatggcacaggcgactgcttaattgctggggaccaccaaggaaatatttatgtttttgacttacatggaaacagtcaccaaggagctagttagctggatgagaggacatgaatcatcagtattttcgatctctgtgcatgcatcagggaaatatgccatcacaacttcttctgatacagcacaattatgggacttggatacctttcagagaaaaagaaagctgaatattcgccagtctgtgggtatacagaaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccagagatggccgaatcctggctgctggaggcaagtcaaatcatcttcatttgtggtgcttggaagctaggcagctctttagaattatccagatgcccactaaagttcgagccattcgccatctggaatttcttcctgatagttttgatgctggttctaatcaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataagccacctccgcctttagtgaaagttattgaagatttgcccaagaataaactgagttccagtgatcttaagatgaaagtaacatcagggagagtacagcagccagcaaaatctagggaaagcaaaatgcaaactagaatattaaaacaagacctgactggtgattttgaaagtaaaaagaatgaattaccagatggattaaacaaaaagcgtttacaaatcttattaaaaggctatggtgaatatccaacaaaatacagaatgttcatttggcgctctctgctacaactgcctgaaaatcatactgcgtttagtaccctcatagataaggggactcatgtggcatttctcaaccttcagaagaaataccccatcaaaagtaggaagctactcagagtattacagagaaccttatctgcattagctcactggtctgtcatttttagtgacacaccatatcttccactcttggcatttccatttgtaaaattattccagaacaaccaactcatctgttttgaagttattgctactctcataatcaattggtgtcaacactggtttgaatattttcctaatcctcctatcaatattcttagcatgatagaaaatgttttggcatttcatgacaaggaactgctgcaacacttcatagatcatgatataacctcccagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagagacagttgaagatatgcaagctaaagtcgaccagcaaagagttgaagatgaagcttggtaccagaaacaggagctgcttcgtaaagctgaagaaacaagaagagaaatgctcttacaagaggaggagaaaatgatacaacaaagacagaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaaggtatatatgagagatcgagaaattgctgccacagccagagacctagaaatgagacagctggaactcgaatcacaaaagagactttatgagaagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaagtggaaggaagctgaaggaaaagagttccgtttgagatcagcaaagaaagcttctgctctttcagatgcgtctagaaagtggtttttaaagcaagagataaatgcggctgtagaacatgctgaaaatccatgtcataaagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgtt

SEQ ID NO: 189583 - DNA, 4431 bp, Homo sapiens
  Payload ID: 17435
  Gene Symbol: TBC1D32
  Gene Name: TBC1 domain family, member 32
  Uniprot ID: Q96NH3
  ENST ID: ENST00000275159
  CDS Start-End: 1-3897
atggcccatttctccagcgaggaccaggcgatgctgcaggcgatgctgaggcggttgttccagagcgtgaaggagaaaatcacgggtgccccttccctggagtgtgccgaagagattcttttacatctggaggaaactgatgaaaattttcacaactatgaatttgtgaaatacctcaggcagcatataggcaacactttgggttctatgattgaagaagaaatggaaaaatgcacatctgatcggaatcagggtgaagaatgcggctatgatacagttgtacagcaggtcactaaaagaactcaagaatctaaagagtacaaagaaatgatgcattacctgaagaacattatgatagctgtggtcgagtctatgattaacaagtttgaagaagatgagacacgaaatcaagaaaggcagaaaaaaatccaaaaggagaaaagccatagttaccgcacagacaattgctctgatagtgattcatcattgaatcagagttacaaattttgtcaaggaaaattacaattgattttagaccagttggatcctgggcaacctaaagaggtgagatatgaagccttgcaaacattatgttcagctcctccatctgatgtcctcaactgtgaaaattggactactctctgcgaaaaactgaccgtgtctctttcagatcctgatcctgtgtttagtgaccggattttaaaattctgtgcacagacatttttgctttctccattacatatgaccaaggaaatttatacaagcttagctaagtatttggagtcatactttctttctagggaaaatcatattcctactctttcagctggtgtagatataactaatcctaatatgactcgcttacttaaaaaggttcgtcttctaaatgaatatcagaaagaagctccatctttctggattcgtcatccagagaagtatatggaagaaattgtggagagtactttgtccttgttaacagttaaacataatcaaagccatgttgtctcacaaaagattttggatccgatctacttttttgcattagttgataccaaggctgtgtggttcaaaaagtggatgcatgcacattatagcagaactacagtattaagacttcttgaaacgaaatataagtctctggtaactacagccattcaacagtgtgttcagtactttgaaatgtgtaagactaggaaagctgatgaaactttgggacattcaaagcattgcagaaacaagcagaaaactttctactacttaggacaagaattacaatatatttatttcattcactcactgtgccttttaggaagattattgatctataaacaaggcagaaaactatttcctattaagctgaagaataaaaaaggtttggtatccctcatagatctgcttgttctttttacccaacttatctattactcaccaagttgtccaaagatgacatcagctgcccattcagagaattactctcctgcaagtatggtgactgaagttctgtggatactcagtgatcaaaaagaatgtgcagtggaatgcttatataacaacattgtaatagagacacttcttcagcctattcacaatttaatgaaaggaaatgaggcatctccaaattgctctgagacagctttaattcatatagctggtattttggcaagaattgcatctgtagaagaagggcttattttactcctttatggagcaaatatgaactcttctgaagaaagtcctacaggtgctcatataattgcccagttttcgaaaaaacttctcgatgaagatatttctatattttctggatcagaaatgttgcctgtggttaaaggagcttttatttctgtgtgtcgtcacatatatagtacatgtgaaggtttgcaggtgttaatcacttataatttgcatgaatctatagcaaaggcatggaaaaagacaagtttgctatcagaaagaattcctactccagtagagggttctgattctgtttcttcagtaagccaggaatcccaaaacattatggcttgggaagataatttgttagatgatttactacattttgctgccacccccaaaggattactacttcttcaaagaacaggtgctatcaatgaatgtgtgacatttatattcaatcgatatgcaaaaaaattacaggtcagcaggcataaaaaatttggctatggagttttggttacacgagtggcatcaacagcagcaggtggcattgcactaaaaaagtcagggtttattaatgaacttataactgaattatggtccaatctggaatatggaagagatgatgttagggtaacccatcccagaactactccagtggatcctattgaccgaagctgtcaaaagtcttttttagcactggtgaacttgttatcctatcctgctatttatgagcttgtaaggaatcaagatcttcctaataaaacagaatattctcttcgtgaagtcccaacatgtgttattgatattattgatagacttataattttgaattctgaagctaagattcgttctttattcaactatgaacaatcacatatctttggtctaaggttattaagtgtgatatgctgtgatctggacactcttctcctgttagaggctcagtatcaggtatctgaaatgttactaaatgctcaagaagaaaatatcttggagatttctgagagccacagggactttataattgatggcttatcagtggagagaaatcatgttcttgttagaataaatcttgttggtgggccattggaacggattttgcctccgaggttactcgaaaagagtgataatccatatccttggccaatgttttcatcatatccattgccaaactgctatctgtcagacattacaagaaatgctggtataaaacaagacaatgatcttgacaagcttttattatgcctcaaaatatctgataaacaaactgaatggatagaaaactgccaaagacaattttgcaaaatgatgaaagccaaacctgatataatcagtggagaggccttaatagaattacttgaaaaatttgtgcttcatctcactgaaagcccatctgaatgctacttcccttcagtggagtatacagctactgatgcaaatgtgaagaatgaaagtctttcatctgtgcagcagcttggcattaaaatgactgtcaggtatggcaaattcctcagtctcttaaaagatggtgcagaaaatgatcttacctgggttttaaagcattgtgagagattcctgaaacagcagcaaacttccataaaatcttctcttctctgcctgcaagggaattatgctggccatgactggtttgtatcttctctgttcatgataatgttgggagacaaagaaaaaacattccaatttcttcatcaattctccaggcttctgacttctgcttttctttggttgccaaggctacatatttctagttaccttcctaatgacactgtagaatctggcatccatccagtatatttttgcagcacccattatattgaaatgctactgaaggctgagttgcctcttgtgttttcagcttttcacatgtctggttttgcaccatcacagatttgcctgcaatggataacccagtgtttttggaattacttagattggatagaaatctgccattatattgctacttgtgttttccttggtcctgattatcaagtgtatatctgtatagctgtattcaaacatttacagcaagacattctacagcacactcagactcaagatctgcaagttttcctaaaagaagaagcactgcatgggtttcgagtgagtgattattttgaatacatggaaattttggaacaaaactaccgaacagtgctgctgagagacatgcggaacattagactgcagagcacatagatcatgagacacacggtttaaatttaggttttatttatttttaaacacagcaggggggcttgatgtttttctgtgtctgtaacaacatttactttgtgaatatacatattgtaaatactgagaagtataacgatatatttaagtaggtatgagctcaatttgtgaattcatttttgtaaatttgttgttttgtaaggttattatagaatcagatctagcttacttttagttcttattcatgtttaagagttagtcctggccaggcgcggtggctcatgcctgtaatcccagcactttgggagtctgaggtgggcggatcacgaggtcaagagatcgagaccatcctggccaaaatggtgaaacctcgtctctgctaacaatactgaaattagctgggtgcagtgatgcgcctgtagtccctgctacttgggaggctgaggcaggagaatcgcttgaacccgggaggcggaggttgcagtgagccaagattgtgccactgtactccagccaggccacagagtgagactctgtctc

SEQ ID NO: 189584 - DNA, 3824 bp, Homo sapiens
  Payload ID: 17435
  Gene Symbol: TBC1D32
  Gene Name: TBC1 domain family, member 32
  Uniprot ID: Q96NH3
  ENST ID: ENST00000398212
  CDS Start-End: 51-3824
gcttttgctcggacctggagtaatgagagtggacgtttgattccaacaggatggcccatttctccagcgaggaccaggcgatgctgcaggcgatgctgaggcggttgttccagagcgtgaaggagaaaatcacgggtgccccttccctggagtgtgccgaagagattcttttacatctggaggaaactgatgaaaattttcacaactatgaatttgtgaaatacctcaggcagcatataggcaacactttgggttctatgattgaagaagaaatggaaaaatgcacatctgatcggaatcagggtgaagaatgcggctatgatacagttgtacagcaggtcactaaaagaactcaagaatctaaagagtacaaagaaatgatgcattacctgaagaacattatgatagctgtggtcgagtctatgattaacaagtttgaagaagatgagacacgaaatcaagaaaggcagaaaaaaatccaaaaggagaaaagccatagttaccgcacagacaattgctctgatagtgattcatcattgaatcagagttacaaattttgtcaaggaaaattacaattgattttagaccagttggatcctgggcaacctaaagaggtgagatatgaagccttgcaaacattatgttcagctcctccatctgatgtcctcaactgtgaaaattggactactctctgcgaaaaactgaccgtgtctctttcagatcctgatcctgtgtttagtgaccggattttaaaattctgtgcacagacatttttgctttctccattacatatgaccaaggaaatttatacaagcttagctaagtatttggagtcatactttctttctagggaaaatcatattcctactctttcagctggtgtagatataactaatcctaatatgactcgcttacttaaaaaggttcgtcttctaaatgaatatcagaaagaagctccatctttctggattcgtcatccagagaagtatatggaagaaattgtggagagtactttgtccttgttaacagttaaacataatcaaagccatgttgtctcacaaaagattttggatccgatctacttttttgcattagttgataccaaggctgtgtggttcaaaaagtggatgcatgcacattatagcagaactacagtattaagacttcttgaaacgaaatataagtctctggtaactacagccattcaacagtgtgttcagtactttgaaatgtgtaagactaggaaagctgatgaaactttgggacattcaaagcattgcagaaacaagcagaaaactttctactacttaggacaagaattacaatatatttatttcattcactcactgtgccttttaggaagattattgatctataaacaaggcagaaaactatttcctattaagctgaagaataaaaaaggtttggtatccctcatagatctgcttgttctttttacccaacttatctattactcaccaagttgtccaaagatgacatcagctgcccattcagagaattactctcctgcaagtatggtgactgaagttctgtggatactcagtgatcaaaaagaatgtgcagtggaatgcttatataacaacattgtaatagagacacttcttcagcctattcacaatttaatgaaaggaaatgaggcatctccaaattgctctgagacagctttaattcatatagctggtattttggcaagaattgcatctgtagaagaagggcttattttactcctttatggagcaaatatgaactcttctgaagaaagtcctacaggtgctcatataattgcccagttttcgaaaaaacttctcgatgaagatatttctatattttctggatcagaaatgttgcctgtggttaaaggagcttttatttctgtgtgtcgtcacatatatagtacatgtgaaggtttgcaggtgttaatcacttataatttgcatgaatctatagcaaaggcatggaaaaagacaagtttgctatcagaaagaattcctactccagtagagggttctgattctgtttcttcagtaagccaggaatcccaaaacattatggcttgggaagataatttgttagatgatttactacattttgctgccacccccaaaggattactacttcttcaaagaacaggtgctatcaatgaatgtgtgacatttatattcaatcgatatgcaaaaaaattacaggtcagcaggcataaaaaatttggctatggagttttggttacacgagtggcatcaacagcagcaggtggcattgcactaaaaaagtcagggtttattaatgaacttataactgaattatggtccaatctggaatatggaagagatgatgttagggtaacccatcccagaactactccagtggatcctattgaccgaagctgtcaaaagtcttttttagcactggtgaacttgttatcctatcctgctatttatgagcttgtaaggaatcaagatcttcctaataaaacagaatattctcttcgtgaagtcccaacatgtgttattgatattattgatagacttataattttgaattctgaagctaagattcgttctttattcaactatgaacaatcacatatctttggtctaagggactttataattgatggcttatcagtggagagaaatcatgttcttgttagaataaatcttgttggtgggccattggaacggattttgcctccgaggttactcgaaaagagtgataatccatatccttggccaatgttttcatcatatccattgccaaactgctatctgtcagacattacaagaaatgctggtataaaacaagacaatgatcttgacaagcttttattatgcctcaaaatatctgataaacaaactgaatggatagaaaactgccaaagacaattttgcaaaatgatgaaagccaaacctgatataatcagtggagaggccttaatagaattacttgaaaaatttgtgcttcatctcactgaaagcccatctgaatgctacttcccttcagtggagtatacagctactgatgcaaatgtgaagaatgaaagtctttcatctgtgcagcagcttggcattaaaatgactgtcaggtatggcaaattcctcagtctcttaaaagatggtgcagaaaatgatcttacctgggttttaaagcattgtgagagattcctgaaacagcagcaaacttccataaaatcttctcttctctgcctgcaagggaattatgctggccatgactggtttgtatcttctctgttcatgataatgttgggagacaaagaaaaaacattccaatttcttcatcaattctccaggcttctgacttctgcttttctttggttgccaaggctacatatttctagttaccttcctaatgacactgtagaatctggcatccatccagtatatttttgcagcacccattatattgaaatgctactgaaggctgagttgcctcttgtgttttcagcttttcacatgtctggttttgcaccatcacagatttgcctgcaatggataacccagtgtttttggaattacttagattggatagaaatctgccattatattgctacttgtgttttccttggtcctgattatcaagtgtatatctgtatagctgtattcaaacatttacagcaagacattctacagcacactcagactcaagatctgcaagttttcctaaaagaagaagcactgcatgggtttcgagtgagtgattattttgaatacatggaaattttggaacaaaactaccgaacagtgctgctgagagacatgcggaacattagactgcagagcacatag

SEQ ID NO: 189585 - DNA, 770 bp, Homo sapiens
  Payload ID: 17435
  Gene Symbol: TBC1D32
  Gene Name: TBC1 domain family, member 32
  ENST ID: ENST00000422369
  CDS Start-End: 130-770
gtcctcccatcagatcattcctgatgtctcttttgttgttagtcgggagagcctgaggtctgctggtactgaaggctagcaactaagagtaccagaggcgagacctcgcggacccctgcttccccaaagatggcccatttctccagcgaggaccaggcgatgctgcaggcgatgctgaggcggttgttccagagcgtgaaggagaaaatcacgggtgccccttccctggagtgtgccgaagagattcttttacatctggaggaaactgatgaaaattttcacaactatgaatttgtgaaatacctcaggcagcatataggcaacactttgggttctatgattgaagaagaaatggaaaaatgcacatctgatcggaatcagggtgaagaatgcggctatgatacagttgtacagcaggtcactaaaagaactcaagaatctaaagagtacaaagaaatgatgcattacctgaagaacattatgatagctgtggtcgagtctatgattaacaagtttgaagaagatgagacacgaaatcaagaaaggcagaaaaaaatccaaaaggagaaaagccatagttaccgcacagacaattgctctgatagtgattcatcattgaatcagagttacaaattttgtcaaggaaaattacaattgattttagaccagttggatcctgggcaacctaaagaggtgagatatgaagccttgcaaacattatgttcagctcctccatctgatgtcctcaactgtgaaaattggactactct

SEQ ID NO: 189586 - DNA, 5323 bp, Homo sapiens
  Payload ID: 17435
  Gene Symbol: TBC1D32
  Gene Name: TBC1 domain family, member 32
  Uniprot ID: Q96NH3
  ENST ID: ENST00000464622
  CDS Start-End: 49-375
ttttgctcggacctggagtaatgagagtggacgtttgattccaacaggatggcccatttctccagcgaggaccaggcgatgctgcaggcgatgctgaggcggttgttccagagcgtgaaggagaaaatcacgggtgccccttccctggagtgtgccgaagagattcttttacatctggaggaaactgatgaaaattttcacaactatgaatttgtgaaatacctcaggcagcatataggcaacactttgggttctatgattgaagaagaaatggaaaaatgcacatctgatcggaatcagggtgaagaatgcggctatgatacagttgtacagcaggtcactaaaagaactcaagaatctaaagaactaccttgaatttaaaggtacaaagaaatgatgcattacctgaagaacattatgatagctgtggtcgagtctatgattaacaagtttgaagaagatgagacacgaaatcaagaaaggcagaaaaaaatccaaaaggagaaaagccatagttaccgcacagacaattgctctgatagtgattcatcattgaatcagagttacaaattttgtcaaggaaaattacaattgattttagaccagttggatcctgggcaacctaaagaggtgagatatgaagccttgcaaacattatgttcagctcctccatctgatgtcctcaactgtgaaaattggactactctctgcgaaaaactgaccgtgtctctttcagatcctgatcctgtgtttagtgaccggattttaaaattctgtgcacagacatttttgctttctccattacatatgaccaaggaaatttatacaagcttagctaagtatttggagtcatactttctttctagggaaaatcatattcctactctttcagctggtgtagatataactaatcctaatatgactcgcttacttaaaaaggttcgtcttctaaatgaatatcagaaagaagctccatctttctggattcgtcatccagagaagtatatggaagaaattgtggagagtactttgtccttgttaacagttaaacataatcaaagccatgttgtctcacaaaagattttggatccgatctacttttttgcattagttgataccaaggctgtgtggttcaaaaagtggatgcatgcacattatagcagaactacagtattaagacttcttgaaacgaaatataagtctctggtaactacagccattcaacagtgtgttcagtactttgaaatgtgtaagactaggaaagctgatgaaactttgggacattcaaagcattgcagaaacaagcagaaaactttctactacttaggacaagaattacaatatatttatttcattcactcactgtgccttttaggaagattattgatctataaacaaggcagaaaactatttcctattaagctgaagaataaaaaaggtttggtatccctcatagatctgcttgttctttttacccaacttatctattactcaccaagttgtccaaagatgacatcagctgcccattcagagaattactctcctgcaagtatggtgactgaagttctgtggatactcagtgatcaaaaagaatgtgcagtggaatgcttatataacaacattgtaatagagacacttcttcagcctattcacaatttaatgaaaggaaatgaggcatctccaaattgctctgagacagctttaattcatatagctggtattttggcaagaattgcatctgtagaagaagggcttattttactcctttatggagcaaatatgaactcttctgaagaaagtcctacaggtgctcatataattgcccagttttcgaaaaaacttctcgatgaagatatttctatattttctggatcagaaatgttgcctgtggttaaaggagcttttatttctgtgtgtcgtcacatatatagtacatgtgaaggtttgcaggtgttaatcacttataatttgcatgaatctatagcaaaggcatggaaaaagacaagtttgctatcagaaagaattcctactccagtagagggttctgattctgtttcttcagtaagccaggaatcccaaaacattatggcttgggaagataatttgttagatgatttactacattttgctgccacccccaaaggattactacttcttcaaagaacaggtgctatcaatgaatgtgtgacatttatattcaatcgatatgcaaaaaaattacaggtcagcaggcataaaaaatttggctatggagttttggttacacgagtggcatcaacagcagcaggtggcattgcactaaaaaagtcagggtttattaatgaacttataactgaattatggtccaatctggaatatggaagagatgatgttagggtaacccatcccagaactactccagtggatcctattgaccgaagctgtcaaaagtgaaatatctcagtatgtctggttctccaagtttctgactctagtgaaaatttttagaaaatgtaaagcagtaaactttacagttgcaatcttttttagcactggtgaacttgttatcctatcctgctatttatgagcttgtaaggaatcaagatcttcctaataaaacagaatattctcttcgtgaagtcccaacatgtgttattgatattattgatagacttataattttgaattctgaagctaagattcgttctttattcaactatgaacaatcacatatctttggtctaaggaaataagccactcactatgggcaatcttagcggatttgagcctcagcttctgaagccaggagacagaatcccagagttcatcattttctttcattactttgtccactgaacttaggagcaaccaaccaacttcattatgttccttggttctccacatatggtcaaaggttattaagtgtgatatgctgtgatctggacactcttctcctgttagaggctcagtatcaggtatctgaaatgttactaaatgctcaagaagaaaatatcttggagatttctgagagccacagggactttataattgatggcttatcagtggagagaaatcatgttcttgttagaataaatcttgttggtgggccattggaacggattttgcctccgaggttactcgaaaagagtgataatccatatccttggccaatgttttcatcatatccattgccaaactgctatctgtcagacattacaagaaatgctggtataaaacaagagatggggccaaagaacaagaataccatattctgtgtctctggagctatgcagcgttcagtgaacaatgatcttgacaagcttttattatgcctcaaaatatctgataaacaaactgaatggatagaaaactgccaaagacaattttgcaaaatgatgaaagccaaacctgatataatcagtggagaggccttaatagaattacttgaaaaatttgtgcttcatctcactgaaagcccatctgaatgctacttcccttcagtggagtatacagatgattacaacaactacttcgcaaagaaaacttggcctgcaggaagaaattcattcattctaccctcatacgttaccatacattaaaagtggaacactgattacttaaagattagtatcaggaacgaaataaccattcttgtatatatttgtaattcagagttttatgtatgcattgcatgatgaaagtagtatttctagaccactttttgggtcaatggctctttttattctgagagccaagtaaaatagattgttttaaaactactattgttatgtatttaatatgttttccaatgctttttatgggaaaaagttatttgtaaaaagttttctgttaattcctttgaaaatgtaactgacagttcctaaaagaataaattcatcagtgttttcaaaattcacattaaaatatgtaaaaatattgctttcatcaattttcaattaaaatgtgattattatgcaaacttttctgcactttataactcagttttctgttgtctttagctactgatgcaaatgtgaagaatgaaagtctttcatctgtgcagcagcttggcattaaaatgactgtcaggtatggcaaattcctcagtctcttaaaagatggtgcagaaaatgatcttacctgggttttaaagcattgtgagagattcctgaaacagcagcaaacttccataaaatcttctcttctctgcctgcaagggaattatgctggccatgactggtttgtatcttctctgttcatgataatgttgggagacaaagaaaaaacattccaatttcttcatcaattctccaggcttctgacttctgcttttctttggttgccaaggctacatatttctagttaccttcctaatgacactgtagaatctggcatccatccagtatatttttgcagcacccattatattgaaatgctactgaaggctgagttgcctcttgtgttttcagcttttcacatgtctggttttgcaccatcacagatttgcctgcaatggataacccagtgtttttggaattacttagattggatagaaatctgccattatattgctacttgtgttttccttggtcctgattatcaagtgtatatctgtatagctgtattcaaacatttacagcaagacattctacagcacactcagactcaagatctgcaagttttcctaaaagaagaagcactgcatgggtttcgagtgagtgattattttgaatacatggaaattttggaacaaaactaccgaacagtgctgctgagagacatgcggaacattagactgcagagcacatagatcatgagacacacggtttaaatttaggttttatttatttttaaacacagcaggggggcttgatgtttttctgtgtctgtaacaacatttactttgtgaatatacatattgtaaatactgagaagtataacgatatatttaagtaggtatgagctcaatttgtgaattcatttttgtaaatttgttgttttgtaaggttattatagaatcagatctagcttacttttagttcttattcatgtttaagagttagtcctggccaggcgcggtggctcatgcctgtaatcccagcactttgggagtctgaggtgggcggatcacgaggtcaagagatcgagaccatcctggccaaaatggtgaaacctcgtctctgctaacaatactgaaattagctgggtgcagtgatgcgcctgtagtccctgctacttgggaggctgaggcaggagaatcgcttgaacccgggaggcggaggttgcagtgagccaagattgtgccactgtactccagccaggccacagagtgagactctgtctc

SEQ ID NO: 189587 - DNA, 754 bp, Homo sapiens
  Payload ID: 17435
  Gene Symbol: TBC1D32
  Gene Name: TBC1 domain family, member 32
  ENST ID: ENST00000509492
  CDS Start-End: 1-204
attacaagaaatgctggtataaaacaagacaatgatcttgacaagcttttattatgcctcaaaatatctgataaacaaactgaatggatagaaaactgccaaagacaattttgcaaaatgatgaaagccaaacctgatataatcagtggagaggtgctcccaatttttaggtttttcctgtgtgagataccatcgagagtataaaatgaaccttaatagaattacttgaaaaatttgtgcttcatctcactgaaagcccatctgaatgctacttcccttcagtggagtatacagctactgatgcaaatgtgaagaatgaaagtctttcatctgtgcagcagcttggcattaaaatgactgtcaggtatggcaaattcctcagtctcttaaaagatggtgcagaaaatgatcttacctgggttttaaagcattgtgagagattcctgaaacagcagcaaacttccataaaatcttctcttctctgcctgcaagggaattatgctggccatgactggtttgtatcttctctgttcatgataatgttgggagacaaagaaaaaacattccaatttcttcatcaattctccaggcttctgacttctgcttttctttggttgccaaggctacatatttctgtaagacttcaatctgtttttaaaggagggtttgaaattttaagaacattatacttacattcactggggcataattttatttgtgaaggactttgtaataaattatactcatttttcta

SEQ ID NO: 189588 - DNA, 1800 bp, Homo sapiens
  Payload ID: 17436
  Gene Symbol: TBC1D3B
  Gene Name: TBC1 domain family, member 3B
  ENST ID: ENST00000611413
  CDS Start-End: 151-1800
actggtgcttagcacctatctgctctctggtctgcctcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaatccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcctggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctag

SEQ ID NO: 189589 - DNA, 569 bp, Homo sapiens
  Payload ID: 17436
  Gene Symbol: TBC1D3B
  Gene Name: TBC1 domain family, member 3B
  ENST ID: ENST00000616006
  CDS Start-End: 423-569
agaatgtcactggtgcttagcacctatctgctctctggcctgcctcagtggtctacagcagttacacacaggcagtggtatctgtgagcagctctgtggactcaaaggttttctccctgagaggcatgacccaggccagctgattcatcagaatcaggtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccag

SEQ ID NO: 189590 - DNA, 2081 bp, Homo sapiens
  Payload ID: 17436
  Gene Symbol: TBC1D3B
  Gene Name: TBC1 domain family, member 3B
  Uniprot ID: A6NDS4
  ENST ID: ENST00000611257
  CDS Start-End: 118-1767
gcctcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaatccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcaggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagaggggccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcgtcctcgttttatttttggttaaacttatgaatatgtattaagaaagagtgcagcttgagagacattcagagatggaacacaccagaccccagatcacaaagccaaccatgcccagcccctcccagcaccccaagccccacgaccatcgttctgaattctgacgacaccgtgagcctgcctttgtactttaaactcatggaaggataactaccttcacgttttgaaataaatgtttcctgttgaaatg

SEQ ID NO: 189591 - DNA, 2082 bp, Homo sapiens
  Payload ID: 17436
  Gene Symbol: TBC1D3B
  Gene Name: TBC1 domain family, member 3B
  ENST ID: ENST00000617942
  CDS Start-End: 118-1767
gcctcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaatccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcctggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatga

SEQ ID NO: 189592 - DNA, 1959 bp, Homo sapiens
  Payload ID: 17436
  Gene Symbol: TBC1D3B
  Gene Name: TBC1 domain family, member 3B
  ENST ID: ENST00000611172
  CDS Start-End: 1-1650
atggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctattttcctgaggaggatgcattctgggcactggtgcagctgctggccagtgagaggcactccctgcagggatttcacagcccaaatggcgggaccgtccaggggctccaagaccaacaggagcatgtggtagccacgtcacaatccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtatgctcccacctcagggccttgcctctgcggcctccacttggaaagttctcagttccctccaggcttctagaagcatctgggccagggctcatggctggataatttccctaggcttaacaacccaagcaagcttcgcgtcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtactttaaactcatggaaggataactaccttcacgttttgaaataaatgtttcctgttg

SEQ ID NO: 189593 - DNA, 575 bp, Homo sapiens
  Payload ID: 17436
  Gene Symbol: TBC1D3B
  Gene Name: TBC1 domain family, member 3B
  ENST ID: ENST00000610580
  CDS Start-End: 115-462
tcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacagtcgggtcaacctcctttccagggacagaactcctccctgactcccctgcaggtccagcccgaggttgttaggccagaggtgtggggcccatctagggagccggtgggaatggagactgggctaggtcaggcccctgggcgctcagcagttctgtcggcaagtgagcacaagaggagcggggcagcctgagggtctggccctgtctacttggagacaaccccgtgagacggagctgcctcctctgactgcgcgggaggcgaagcaaattcggcgggagatcagccgaaagagcaagtgggtgg

SEQ ID NO: 189594 - DNA, 2135 bp, Homo sapiens
  Payload ID: 17436
  Gene Symbol: TBC1D3B
  Gene Name: TBC1 domain family, member 3B
  Uniprot ID: A6NDS4
  ENST ID: ENST00000615673
  CDS Start-End: 115-1764
tcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaatccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcaggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagaggggccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcgtcctcgttttatttttggttaaacttatgaatatgtattaagaaagagtgcagcttgagagacattcagagatggaacacaccagaccccagatcacaaagccaaccatgcccagcccctcccagcaccccaagccccacgaccatcgttctgaattctgacgacaccgtgagcctgcctttgtactttaaactcatggaaggataactaccttcacgttttgaaataaatgtttcctgttgaaatgcttttagattttagacagaaatattgaaaaggcactatagtgtcctcctataccttc

SEQ ID NO: 189595 - DNA, 575 bp, Homo sapiens
  Payload ID: 17436
  Gene Symbol: TBC1D3B
  Gene Name: TBC1 domain family, member 3B
  ENST ID: ENST00000633360
  CDS Start-End: 115-462
tcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacagtcgggtcaacctcctttccagggacagaactcctccctgactcccctgcaggtccagcccgaggttgttaggccagaggtgtggggcccatctagggagccggtgggaatggagactgggctaggtcaggcccctgggcgctcagcagttctgtcggcaagtgagcacaagaggagcggggcagcctgagggtctggccctgtctacctggagacaaccccgtgagacggagctgcctcctctgactgcgcgggaggcgaagcaaattcggcgggagatcagccgaaagagcaagtgggtgg

SEQ ID NO: 189596 - DNA, 2081 bp, Homo sapiens
  Payload ID: 17436
  Gene Symbol: TBC1D3B
  Gene Name: TBC1 domain family, member 3B
  ENST ID: ENST00000632779
  CDS Start-End: 118-1767
gcgtcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctattttcctgaggaggatgcattctgggcactggtgcagctgctggccagtgagaggcactccctgcagggatttcacagcccaaatggcgggaccgtccaggggctccaagaccaacaggagcatgtggtagccacgtcacaatccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtatgctcccacctcagggccttgcctctgcggcctccacttggaaagttctcagttccctccaggcttctagaagcatctgggccagggctcatggctggataatttccctaggcttaacaacccaagcaagcttcgcgtcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtactttaaactcatggaaggataactaccttcacgttttgaaataaatgtttcctgttgaaatg

SEQ ID NO: 189597 - DNA, 569 bp, Homo sapiens
  Payload ID: 17436
  Gene Symbol: TBC1D3B
  Gene Name: TBC1 domain family, member 3B
  ENST ID: ENST00000631380
  CDS Start-End: 423-569
agaatgtcactgctgcttagcacctatctgctctctggcctgcctcagtggtctacagcagttacacacaggcagtggtatctgtgagcagctctgtggactcaaaggttttctccctgagaggcatgacccaggccagctgattcatcagaatcaggtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccag

SEQ ID NO: 189598 - DNA, 575 bp, Homo sapiens; identical to SEQ ID NO: 189593
  Payload ID: 17436
  Gene Symbol: TBC1D3B
  Gene Name: TBC1 domain family, member 3B
  ENST ID: ENST00000632876
  CDS Start-End: 115-462

SEQ ID NO: 189599 - DNA, 569 bp, Homo sapiens
  Payload ID: 17436
  Gene Symbol: TBC1D3B
  Gene Name: TBC1 domain family, member 3B
  ENST ID: ENST00000631669
  CDS Start-End: 423-569
agaatgtcactggtgcttagcacctatctgctctctggcctgcgtcagtggtctacagcagttacacacaggcagtggtatctgtgagcagctctgtggactcaaaggttttctccctgagaggcatgacccaggccagctgattcatcagaatcaggtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccag

SEQ ID NO: 189600 - DNA, 1650 bp, Homo sapiens
  Payload ID: 17437
  Gene Symbol: TBC1D3C
  Gene Name: TBC1 domain family, member 3C
  ENST ID: ENST00000617125
  CDS Start-End: 1-1650
atggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtacaacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctag

SEQ ID NO: 189601 - DNA, 2063 bp, Homo sapiens
  Payload ID: 17437
  Gene Symbol: TBC1D3C
  Gene Name: TBC1 domain family, member 3C
  Uniprot ID: Q6IPX1
  ENST ID: ENST00000622206
  CDS Start-End: 99-1748
gttacacacaggcagtggtatctgtgagcagctctgtggactcaaaggttttctccctgagaggcacgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtacaacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctacctttgtacttcaaactcatggaaggataaccaccttcatgttttgaaataaatgtttcctgttgaaatga

SEQ ID NO: 189602 - DNA, 2116 bp, Homo sapiens
  Payload ID: 17438
  Gene Symbol: TBC1D3D
  Gene Name: TBC1 domain family, member 3D
  Uniprot ID: A0A087WVF3
  ENST ID: ENST00000616101
  CDS Start-End: 158-1807
gaatgtcactggtgcttagcacctatctgctctctggtctgcctcagtggtctacagcagttacacacaggcagtggtatctgtgagcagctctgtggactcaaaggttttctccctgagaggcacgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccggcccctcccagcacccccagccccacgaccatcgttctgaattctgacgacaccgtgagcctgcctttgtacttcaaactcatggaaggataaccaccttcatgttttgaaataaatgtttcctgttg

SEQ ID NO: 189603 - DNA, 2305 bp, Homo sapiens
  Payload ID: 17438
  Gene Symbol: TBC1D3D
  Gene Name: TBC1 domain family, member 3D
  Uniprot ID: A0A087WVF3
  ENST ID: ENST00000618737
  CDS Start-End: 158-1807
gaatgtcactggtgcttagcacctatctgctctctggtctgcctcagtggtctacagcagttacacacaggcagtggtatctgtgagcagctctgtggactcaaaggttttctccctgagaggcacgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatgattttagattttagacagaaatattgaaaaggcactatagtatcctcctataccttccatccagctgcccctaataatgatgttttgcagtcccatggcacataagaaatttaggccgggtgtggtggctcacacctgtaatcccagcaatttgagaggtcgaggcgggaggttcaggttcact

SEQ ID NO: 189604 - DNA, 2076 bp, Homo sapiens
  Payload ID: 17439
  Gene Symbol: TBC1D3E
  Gene Name: TBC1 domain family, member 3E
  Uniprot ID: A0A087X179
  ENST ID: ENST00000621587
  CDS Start-End: 118-1767
gcctcagtggtctacagcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcaagcgtacaagggaatgcccatgaacatccggggcccgatgtggtcagtcctcctgaacactgaggaaatgaagttgaaaaaccccggaagataccagatcatgaaggagaagggcaagaagtcatctgagcacatccagcgcatcgaccgggacgtaagcgggacattaaggaagcatatattcttcagggatcgatacggaaccaagcagcgggaactactccacatcctcctggcatatgaggagtacaacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgctgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttg

SEQ ID NO: 189605 - DNA, 1650 bp, Homo sapiens
  Payload ID: 17439
  Gene Symbol: TBC1D3E
  Gene Name: TBC1 domain family, member 3E
  ENST ID: ENST00000617226
  CDS Start-End: 1-1650
atggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtacaacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgctgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctag

SEQ ID NO: 189606 - DNA, 2117 bp, Homo sapiens
  Payload ID: 17440
  Gene Symbol: TBC1D3F
  Gene Name: TBC1 domain family, member 3F
  ENST ID: ENST00000620210
  CDS Start-End: 158-1645
gaatgtcactggtgcttagcacctatctgctctctggcctgcgtcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtacaacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacgtgccacccccagccaaacccgagcaagggtcgtcggcatccaggcctgtgccggcttcacgtggcgggaagaccctctgcaagggggacagacaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaaccgacctggacgtagagggcccttggttccgccattatgatttcagacagagctgctgggtccgtgccatatcccaggaggaccagctggccccctgctggcaggcctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttg

SEQ ID NO: 189607 - DNA, 2115 bp, Homo sapiens
  Payload ID: 17440
  Gene Symbol: TBC1D3F
  Gene Name: TBC1 domain family, member 3F
  Uniprot ID: A6NER0
  ENST ID: ENST00000614193
  CDS Start-End: 151-1800
actggtgcttagcacctatctgctctctggcctgcgtcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtacaacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacgtgccacccccagccaaacccgagcaagggtcgtcggcatccaggcctgtgccggcttcacgtggcgggaagaccctctgcaagggggacagacaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaaccgacctggacgtagagggcccttggttccgccattatgatttcagacagagctgctgggtccgtgccatatcccaggaggaccagctggccccctgctggcaggccgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatga

SEQ ID NO: 189608 - DNA, 1650 bp, Homo sapiens
  Payload ID: 17440
  Gene Symbol: TBC1D3F
  Gene Name: TBC1 domain family, member 3F
  ENST ID: ENST00000613793
  CDS Start-End: 1-1650
atggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtacaacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctag

SEQ ID NO: 189609 - DNA, 2117 bp, Homo sapiens; identical to SEQ ID NO: 189606
  Payload ID: 17440
  Gene Symbol: TBC1D3F
  Gene Name: TBC1 domain family, member 3F
  ENST ID: ENST00000634036
  CDS Start-End: 158-1645

SEQ ID NO: 189610 - DNA, 2065 bp, Homo sapiens
  Payload ID: 17441
  Gene Symbol: TBC1D3G
  Gene Name: TBC1 domain family, member 3G
  Uniprot ID: Q6DHY5
  ENST ID: ENST00000569055
  CDS Start-End: 101-1750
cagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatga

SEQ ID NO: 189611 - DNA, 2065 bp, Homo sapiens; identical to SEQ ID NO: 189610
  Payload ID: 17441
  Gene Symbol: TBC1D3G
  Gene Name: TBC1 domain family, member 3G
  Uniprot ID: Q6DHY5
  ENST ID: ENST00000617387
  CDS Start-End: 101-1750

SEQ ID NO: 189612 - DNA, 2114 bp, Homo sapiens
  Payload ID: 17442
  Gene Symbol: TBC1D3H
  Gene Name: TBC1 domain family, member 3H
  Uniprot ID: P0C7X1
  ENST ID: ENST00000622584
  CDS Start-End: 151-1800
actggtgcttagcacctgtctgctctctggcctgcctcagtggtctacagcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcgtcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatg

SEQ ID NO: 189613 - DNA, 2305 bp, Homo sapiens
  Payload ID: 17442
  Gene Symbol: TBC1D3H
  Gene Name: TBC1 domain family, member 3H
  ENST ID: ENST00000618732
  CDS Start-End: 158-1807
gaatgtcactggtgcttagcacctatctgctctctggcctgcgtcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatgattttagattttagacagaaatattgaaaaggcactatagtatcctcctataccttccatccagctgcccctaataatgatgttttgcagtcccatggcacataagaaatttaggccgggtgtggtggctcacacctgtaatcccagcaatttgagaggtcgaggcgggaggttcaggttcact

SEQ ID NO: 189614 - DNA, 2065 bp, Homo sapiens
  Payload ID: 17442
  Gene Symbol: TBC1D3H
  Gene Name: TBC1 domain family, member 3H
  Uniprot ID: P0C7X1
  ENST ID: ENST00000619743
  CDS Start-End: 101-1750
cagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatga

SEQ ID NO: 189615 - DNA, 2065 bp, Homo sapiens; identical to SEQ ID NO: 189614
  Payload ID: 17442
  Gene Symbol: TBC1D3H
  Gene Name: TBC1 domain family, member 3H
  Uniprot ID: P0C7X1
  ENST ID: ENST00000610350
  CDS Start-End: 101-1750

SEQ ID NO: 189616 - DNA, 2122 bp, Homo sapiens
  Payload ID: 17443
  Gene Symbol: TBC1D3I
  Gene Name: TBC1 domain family, member 3I
  ENST ID: ENST00000619234
  CDS Start-End: 158-1807
gaatgtcactggtgcttagcacctatctgctctctggtctgcctcagtggtctacagcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagatgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcgtcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatga

SEQ ID NO: 189617 - DNA, 1790 bp, Homo sapiens
  Payload ID: 17443
  Gene Symbol: TBC1D3I
  Gene Name: TBC1 domain family, member 3I
  ENST ID: ENST00000618421
  CDS Start-End: 141-1790
agcacctatctgctctctggtctgcctcagtggtctacagcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagatgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctag

SEQ ID NO: 189618 - DNA, 1033 bp, Homo sapiens
  Payload ID: 17443
  Gene Symbol: TBC1D3I
  Gene Name: TBC1 domain family, member 3I
  ENST ID: ENST00000618709
  CDS Start-End: 158-1033
gaatgtcactggtgcttagcacctatctgctctctggtctgcctcagtggtctacagcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagatgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcagagcgcctcacgaagacgtccaggtgtggcccgtgggcacgtttttgcaaccggttcgttgatacctgggccagggatgaggacactgtgctcaagcatcttagggcctctatga

SEQ ID NO: 189619 - DNA, 1900 bp, Homo sapiens
  Payload ID: 17443
  Gene Symbol: TBC1D3I
  Gene Name: TBC1 domain family, member 3I
  ENST ID: ENST00000618620
  CDS Start-End: 102-977
gcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagatgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcagagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcgtcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatga

SEQ ID NO: 189620 - DNA, 990 bp, Homo sapiens
  Payload ID: 17443
  Gene Symbol: TBC1D3I
  Gene Name: TBC1 domain family, member 3I
  ENST ID: ENST00000619628
  CDS Start-End: 115-990
tcagtggtctacagcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagatgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcagagcgcctcacgaagacgtccaggtgtggcccgtgggcacgtttttgcaaccggttcgttgatacctgggccagggatgaggacactgtgctcaagcatcttagggcctctatga

SEQ ID NO: 189621 - DNA, 1900 bp, Homo sapiens; identical to SEQ ID NO: 189619
  Payload ID: 17443
  Gene Symbol: TBC1D3I
  Gene Name: TBC1 domain family, member 3I
  ENST ID: ENST00000621187
  CDS Start-End: 102-977

SEQ ID NO: 189622 - DNA, 1790 bp, Homo sapiens; identical to SEQ ID NO: 189617
  Payload ID: 17443
  Gene Symbol: TBC1D3I
  Gene Name: TBC1 domain family, member 3I
  Uniprot ID: A0A087WXS9
  ENST ID: ENST00000621034
  CDS Start-End: 141-1790

SEQ ID NO: 189623 - DNA, 1982 bp, Homo sapiens
  Payload ID: 17443
  Gene Symbol: TBC1D3I
  Gene Name: TBC1 domain family, member 3I
  ENST ID: ENST00000616671
  CDS Start-End: 1-876
atggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagatgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcagagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcgtcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatgattttagattttagacagaaatattgaaaaggcactatagtatcctcctataccttccatccagctgcccctaataatgatgttttgcagtcccatggcacataagaaatttaggccgggtgtggtggctcacacctgtaatcccagcaatttgagaggtcgaggcgggaggttcaggttcact

SEQ ID NO: 189624 - DNA, 2105 bp, Homo sapiens
  Payload ID: 17443
  Gene Symbol: TBC1D3I
  Gene Name: TBC1 domain family, member 3I
  ENST ID: ENST00000620899
  CDS Start-End: 147-1796
gtgcttagcacctatctgctctctggcctgcgtcagtggtctacagcagttacacacaggcagtggtatctgtgagcagctctgtggactcaaaggttttctccctgagaggcatgacccaggccagctgattcatcagaatcaggatggacgtggtagaggtcgcgggtagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacataagcgggacattaaggaagcatatgttcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcgtcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttg

SEQ ID NO: 189625 - DNA, 1900 bp, Homo sapiens; identical to SEQ ID NO: 189619
  Payload ID: 17443
  Gene Symbol: TBC1D3I
  Gene Name: TBC1 domain family, member 3I
  ENST ID: ENST00000633066
  CDS Start-End: 102-977

SEQ ID NO: 189626 - DNA, 2116 bp, Homo sapiens
  Payload ID: 17444
  Gene Symbol: TBC1D3K
  Gene Name: TBC1 domain family, member 3K
  Uniprot ID: A0A087X1G2
  ENST ID: ENST00000620247
  CDS Start-End: 158-1807
gaatgtcactggtgcttagcacctatctgctctctggcctgcgtcagtggtctacagcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaagtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagaagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcaggcagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagcagtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttg

SEQ ID NO: 189627 - DNA, 2116 bp, Homo sapiens
  Payload ID: 17444
  Gene Symbol: TBC1D3K
  Gene Name: TBC1 domain family, member 3K
  ENST ID: ENST00000618095
  CDS Start-End: 158-1807
gaatgtcactggtgcttagcacctatctgctctctggcctgcctcagtggtctacagcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttg

SEQ ID NO: 189628 - DNA, 2065 bp, Homo sapiens
  Payload ID: 17445
  Gene Symbol: TBC1D3L
  Gene Name: TBC1 domain family, member 3L
  Uniprot ID: B9A6J9
  ENST ID: ENST00000617678
  CDS Start-End: 101-1750
cagttacacacaggcagtggtatctgtgagcagctctgtggactcaaaggttttctccctgagaggcacgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatga

SEQ ID NO: 189629 - DNA, 2305 bp, Homo sapiens
  Payload ID: 17445
  Gene Symbol: TBC1D3L
  Gene Name: TBC1 domain family, member 3L
  Uniprot ID: B9A6J9
  ENST ID: ENST00000618047
  CDS Start-End: 158-1807
gaatgtcactggtgcttagcacctatctgctctctggtctgcctcagtggtctacagcagttacacacaggcagtggtatctgtgagcagctctgtggactcaaaggttttctccctgagaggcacgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatgattttagattttagacagaaatattgaaaaggcactatagtatcctcctataccttccatccagctgcccctaataatgatgttttgcagtcccatggcacataagaaatttaggccgggtgtggtggctcacacctgtaatcccagcaatttgagaggtcgaggcgggaggttcaggttcact

SEQ ID NO: 189630 - DNA, 2148 bp, Homo sapiens
  Payload ID: 17445
  Gene Symbol: TBC1D3L
  Gene Name: TBC1 domain family, member 3L
  Uniprot ID: B9A6J9
  ENST ID: ENST00000612727
  CDS Start-End: 1-1650
atggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacactgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgcaacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttgaaatgattttagattttagacagaaatattgaaaaggcactatagtatcctcctataccttccatccagctgcccctaataatgatgttttgcagtcccatggcacataagaaatttaggccgggtgtggtggctcacacctgtaatcccagcaatttgagaggtcgaggcgggaggttcaggttcact

SEQ ID NO: 189631 - DNA, 2116 bp, Homo sapiens
  Payload ID: 17445
  Gene Symbol: TBC1D3L
  Gene Name: TBC1 domain family, member 3L
  ENST ID: ENST00000617279
  CDS Start-End: 158-1807
gaatgtcactggtgcttagcacctatctgctctctggcctgcctcagtggtctacagcagttacacacaggcagtggtatctgtgagcagctctgtggactcaaaggttttctccctgagaggcatgacccaggccagctgattcatcagaatcaggatggacgtggtagaggtcgcgggcagttggtgggcacaagagcgagaggacatcattatgaaatacgaaaagggacaccgagctgggctgccagaggacaaggggcctaagccttttcgaagctacaacaacaacgtcgatcatttggggattgtacatgagacggagctgcctcctctgactgcgcgggaggcgaagcaaattcggcgggagatcagccgaaagagcaagtgggtggatatgctgggagactgggagaaatacaaaagcagcagaaagctcatagatcgagcgtacaagggaatgcccatgaacatccggggcccgatgtggtcagtcctcctgaacattgaggaaatgaagttgaaaaaccccggaagataccagatcatgaaggagaagggcaagaggtcatctgagcacatccagcgcatcgaccgggacgtaagcgggacattaaggaagcatatattcttcagggatcgatacggaaccaagcagcgggaactactccacatcctcctggcatatgaggagtataacccggaggtgggctactgcagggacctgagccacatcgccgccttgttcctcctctatcttcctgaggaggatgcattctgggcactggtgcagctgctggccagtgagaggcactccctgcagggatttcacagcccaaatggcgggaccgtccaggggctccaagaccaacaggagcatgtggtagccacgtcacaacccaagaccatggggcatcaggacaagaaagatctatgtgggcagtgttccccgttaggctgcctcatccggatattgattgacgggatctctctcgggctcaccctgcgcctgtgggacgtgtatctggtagaaggcgaacaggcgttgatgccgataacaagaatcgcctttaaggttcagcagaagcgcctcacgaagacgtccaggtgtggcccgtgggcacgtttttgcaaccggttcgttgatacctgggccagggatgaggacactgtgctcaagcatcttagggcctctatgaagaaactaacaagaaagcagggggacctgccacccccagccaaacccgagcaagggtcgtcggcatccaggcctgtgccggcttcacgtggcgggaagaccctctgcaagggggacaggcaggcccctccaggcccaccagcccggttcccgcggcccatttggtcagcttccccgccacgggcacctcgttcttccacaccctgtcctggtggggctgtccgggaagacacctaccctgtgggcactcagggtgtgcccagcccggccctggctcagggaggacctcagggttcctggagattcctgcagtggaactccatgccccgcctcccaacggacctggacgtagagggcccttggttccgccattatgatttcagacagagctgctgggtccgtgccatatcccaggaggaccagctggccccctgctggcaggctgaacaccctgcggagcgggtgagatcggctttcgctgcacccagcactgattccgaccagggcacccccttcagagctagggacgaacagccgtgtgctcccacctcagggccttgcctctgcggcctccacttggaaagttctcagttccctccaggcttctagaagcatctgggccagggctcatggctggataatttccctaggcttaacaacccaagcaagcttcgcatcctcgttttatttttggttaaacttatgaaaatgtattaagaaagagtgcagctcgagagagattcagagatggaacacaccagaccccagatcacaaagccaaccatgcccagcccctcccagcacccccagccccacgaccatcgttctgaattctgacgacaccgtgagcctgcctttgtacttcaaactcatggaaggataaccaccttcatgttttgaaataaatgtttcctgttg

SEQ ID NO: 189632 - DNA, 6182 bp, Homo sapiens
  Payload ID: 17446
  Gene Symbol: TBC1D4
  Gene Name: TBC1 domain family, member 4
  Uniprot ID: O60343
  ENST ID: ENST00000377625
  CDS Start-End: 348-4055
gcggccgcggggaccctcggcgtggtcctctgaccctgcaaacccgcgacggaggaaggggaggtcctgcccgaggcgccagcccaaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggttcctgatgttattagcagcataaggcaattatctaaagcggccatgaaagaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggggagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttgtattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagcgcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttcttgacgt

SEQ ID NO: 189633 - DNA, 6364 bp, Homo sapiens
  Payload ID: 17446
  Gene Symbol: TBC1D4
  Gene Name: TBC1 domain family, member 4
  Uniprot ID: O60343
  ENST ID: ENST00000377636
  CDS Start-End: 348-4244
gcggccgcggggaccctcggcgtggtcctctgaccctgcaaacccgcgacggaggaaggggaggtcctgcccgaggcgccagcccaaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggttcctgatgttattagcagcataaggcaattatctaaagcggccatgaaagaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggggagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagcaatctttcgtcagttcgacgcatgtacaaggagagtaattcttcctccagtcttccaagtcttcacacttccttctctgccccttccttcactgccccctctttcctgaaaagcttttaccagaattcaggtagactgtccccacagtatgaaaatgaaatcagacaagacactgcttcagaatcaagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttgtattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagcgcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttc

SEQ ID NO: 189634 - DNA, 6347 bp, Homo sapiens
  Payload ID: 17446
  Gene Symbol: TBC1D4
  Gene Name: TBC1 domain family, member 4
  Uniprot ID: O60343
  ENST ID: ENST00000431480
  CDS Start-End: 348-4220
gcggccgcggggaccctcggcgtggtcctctgaccctgcaaacccgcgacggaggaaggggaggtcctgcccgaggcgccagcccaaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggcagttggcacagtttcggcggcgccttctgcgcgggagtggggggcgcggtgcgcccggccggcctccgcggtgccctggtgaggcgagagttatggagccgcccagctgcattcaggatgagccgttcccgcaccccctggagcccgagccgggcgtctcagctcagcccggccccgggaagccaagcgataagcggttccggctgtggtacgttggggggtcgtgcctggaccacaggaccacgctgcctatgctgccctggctcatggccgagatccgcaggcgcagccagaagcccgaggcgggcggctgcggggcgccggcggcccgagaggtgatcctggtgctcagcgcgcccttcctgcgttgcgtccccgcgccgggcgctggggcctcggggggcactagtccgtcggccacgcagcccaacccggcggtattcatcttcgagcacaaggcgcagcatatctcgcgcttcatccacaacagccacgacctcacctactttgcctacctgatcaaggcgcagcccgacgaccccgagtcgcagatggcctgccacgttttccgcgccacagaccccagccaggttcctgatgttattagcagcataaggcaattatctaaagcggccatgaaagaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggggagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggttgggcgatttgagattaaccttatcagtccagacactaaatcagttgtgctagaaaagaattttaaagatatctcctcttgttctcagggtataaagcatgtggatcactttggctttatctgccgggagtctccagagcctggacttagccagtatatttgttatgtattccagtgtgccagcgaatctctggttgatgaggtaatgctgactctgaaacaggccttcagtacggcggctgccctgcagagtgccaagacgcagattaaactgtgtgaggcctgcccgatgcactctttgcataagctctgtgaaaggattgaaggtctctacccaccaagagccaagctggtgatacagaggcatctctcatcactgacagataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagcaatctttcgtcagttcgacgcatgtacaaggagagtaattcttcctccagtcttccaagtcttcacacttccttctctgccccttccttcactgccccctctttcctgaaaagcttttaccagaattcaggtagactgtccccacagtatgaaaatgaaatcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttgtattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttgatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagcgcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttcttgacgt

SEQ ID NO: 189635 - DNA, 847 bp, Homo sapiens
  Payload ID: 17446
  Gene Symbol: TBC1D4
  Gene Name: TBC1 domain family, member 4
  ENST ID: ENST00000413735
  CDS Start-End: 1-847
gataatgagcaagctgacatctttgaaagagttcagaaaatgaagccagtcagtgaccaggaagaaaatgaacttgtgattttacacctgaggcagctgtgtgaagccaagcagaagacacacgtgcacatcggggaaggcccttctactatttcaaatagtacaatcccagaaaatgcaacaagcagtggaaggttcaaacttgacattctgaaaaataaagctaagagatccttaactagctccctggaaaatatcttctcaaggggagctaacagaatgagaggtcggcttggaagtgtggacagttttgaacggtccaacagtcttgcttcagagaaggactactcaccaggggattctccaccagggacaccgccagcgtccccaccgtcctcagcttggcaaacgtttcccgaagaggattccgactccccgcagtttcgaagacgggcacacacgttcagccacccaccttcaagcacaaagagaaagctgaatttgcaggatgggagggctcagggtgtgcgttcccctctgctgaggcagagctccagtgaacagtgcagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaagatggattggacaggaacgagctgctgccactgtcccccctctctccaaccatggaggaggaaccgctggttgtattcctgtctggggaggatgacccagaaaagattgaagaaagaa

SEQ ID NO: 189636 - DNA, 7854 bp, Homo sapiens
  Payload ID: 17447
  Gene Symbol: TBC1D5
  Gene Name: TBC1 domain family, member 5
  Uniprot ID: Q92609
  ENST ID: ENST00000253692
  CDS Start-End: 1666-4053
tgactgcatcacctggtctgtgaattttccattagaagcttggtgtgctgttaggtgaaagacttgctcagctatgcgtcattgggttttatcaacatataggcgaaaaaaatcctggtctctgagtgtacagctgagatgaaaatttcttttattggaggaagtattgagtgtgtgctctcaaatgcggcctcagttgagtagtgcattcctgagttttggaagcaaatttgcaaacaattgagagtcgtacagtgggtgttctaactggattcaggttttttctaatgtaattttttcacacgtaaattaaaaagtttagaaatgtcacacataacttcataacactttatggagaaatggttgtacttttaatttttttctttttatttatactccaactgactgagcagaggttgtacttctaaataactttgtggaagtttttagtaccataatttttataattttcattccagtcctttgatatttatgacagtacttctgaagcgcttactgagtgccggacactgttgtaagtgctttacggaacttgacttttttttttttttgagacggactctcgctctgtcgcccaggctggagtgcagtggtgcagtggctcgatctcggctcactgccacctctccctcatggtttcaaacacttctcctgcctcagcctcccaggtagccaggattatagccgcccgccaccactcccgactaattttattttgtatgttcttttttagtagagacggaggagtttcaccatgttggccaggctggtatcgacctcctgacctcaagtgatgtgtccatctcggcctcccaaggtgctggaattacaggtgtgagccactgtgctcggcctacctttttttttttgttttttgtttttttgaaaaggagtttcgctcttgtccaggctggagtataatggtgcgatctcagctcaccgcaatctccgcctcccagattcaagcgattctcctgcctcagcctcctcaggagctgggattacaggcgcccaccgccatgcccggctaatttttgtatttttagtagagacggggtttcactatattggccaggctggtctcgaactgctgacctcaagtaatccgcctgcctcagcctcccaaagtgctgggattacagacgtgatccaccaggatcacaccaggccgcgcctggcctgctttcattttaaaagtcaaatttgtcatccgcctcagtgcttgtaatcttttctgagtgagatactgaaatttgcagtttcgttttgcttgcacttgttcactggaccagtagtcactgttaaatgtaaaagtatctacttcctctgaaagttttttattcctttatttcctgcctgggcttgtcctccaccctacatgtatgcgtagtagatttagtgtttgttatcctaacctttaggtttagggattgactgggtttctgactttttatttggccaatgaggacgatacagaaaatgaagcattggtcattatcacattttaacgctgaaaaagtaagaaggacaaccccggaataaaatgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcattttgcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttcgtatcttctatccctcaaagcatcagacatgggaaaattggtttataccaagaaagcttcctctgtggaaatctgtctcagcctactttattcctgcattgggaagccatatcgcagagctaaatgcaatagaatgaaccagaactagtggattccagggctgggggaaaaaaaaaaagaaaaaacctcattactgacctctcaaagttataaggatctctgcaaacaggatctaagcttaggaataatatttaggtgtgatatagtgttagatttttttgatgtattaaagaatgcatctccaatccttaggccatatcaactttggccatcaatatctctccttaaacaattatatttcaccttttagaatctttcatagccagaaaacaagattactgtaagccagttttagctgcactgatttcaaaagatataagaatattactatccttcaaatggaaaatgcgaccttgactttatgggataaacatctttcagacagtcagttttctagtcaggtttctctggtttcagagctgtatatacctgtcaactgaggaataaagggaaaaacccaagttcattcccacccaaagtcagaatccctcattggccttaaggtagcagtcataagacagagaattggacctagagtcccttctgtggggaataaggatacctagagaacattccacatgccaagaggatgcaggatttctacacaaccccttcccttcttggaagtcaagtgtaggtactgcagggcctgtgctcagctgtgaaccccgtatcctgggccccactgccgggaccgggtctgacatgccagtgccttcctgggctgagcacagattagagactctcccccttgtcagtcagcaccttaggaaaccatgatgggcacagagcatcacatgagctgtttctctccttaaagaagatccctggaaaggatgcttttcctctcctttgcctgcgcaggaattctaacaggagtgggtgaggatggcagagggacacagtgcctgtctcgcctccatcagggagagcagccatgccagggatgactagctctttgagcctgtcctcagaggatggcgaggcagccgggcagtggaggccttcatggtaacaaatgaaagctcagtatagaggaacagacactgtttacgtccctcccactgctaaccttatatatctctatagacaaatgtgataatgacatgatttcccacctgccctccaagaaaatggtgactcactctcaagtcagctactgtagagagggttctaattggttctgcaatttgctcttaaactctagcagggaactctcctcttaccacatcagcatgtaaggtgaataataactggttttgccagacagcaggttgtctgaccttcaaccactgggcaattgcctggcagatgcacacagtagctccctggcttctggctctgagtgttcctctcagcacctctgagtaagctgctgccaagcacatatccctatgacaacactttgtaaaagccgcggggcccccatacagcgagtgaccttgcaactgtgcagggttgccattggtcactttctcaccttgggaaggtgtcagtgttttcagttctaaggtaagaggtgtagagctgttcccaccagggctctgggacagactggaaaggaccacagacctggccatccctgggcagcagggccagtgtcacctgctgacctctagtatttcctttgccctagagctagagtcatgatagctgagggtcactcgccctgcaagagtcactaggcacccaccatgccaataaggctctccgctggctccctgcagttggctgggtgtttaatagtcactgaaaactcccagccctgctgcacactagaggcaggtcctctcggtcctctccatcctgtgcttctgtggcccccagcaagctcaccacctccttggaggagagagacatacaaggacagtgggtcatgggtagtaccagcctcaaattcccacaggctcatactcagacaattgtattactgccttatgttttttaagtgtttttttaaattcttcatagttgagtattatttgcaattttattagttacagtgctattaaagaatatgtgctcctttttattatattatcagatacttatgtttaattgtacattttttaaatcctgaatatattgtgttttgttaacaaatgtaatcagtggaacccttcttacgttttgattattagcagttaaatacattttgtatacatgaagcttagattaattcccatcatcatcatctcctgtttttatatgtgtccctatgtgtttcatgcattcctctttgatcagattggaatttgagttaaaatttagctttgtacattacgtgtgagagttacagactagcaagtctaattactttgccttaccttgagtgtatgccacagggtcagataacacattaaacatttagttacactggattactcttccaaagctgacctcctgctaatgttcagaggtaactgcaatccggaaagaaataatatcactgcagaaagaatgtgactctaaaaataaaccaggacctccctgtgatttgccttgcctgcagatgaccagttgactcttgtgctgtcagccctggggttgctaaggaagctgcttcagggagttgggggttagttgcccgctctcaacaggaatgcctcctctactttgtcagagatgctgaacaaatatcaaactctgtggcagtcatgctggcctcctaagaataacctgtgagtcagagttgatgcacattatttttgtttttattttatttttttaaggaactgctccaagggttcattatagaacaggagtgtgtacggaggacttaggtccccacatagagtggccgttctgtggcggctccaaccaattccatccctcctttcctgcggacacacacctggcccctggcccctgccctgtgtgtctggaggaggggcactggggaggctgtggagcagagagaagaggccggatacattgaggatggcacctggcaagccaggcttccttctcaaaggccagactgctttctcagtgttacttactaaagctctctttttatactgttaaaaagatatataaagttcgtataaacaggcttgagaccactttgatgtaaaagctgtcatagtagtttttctcacagtggcacaattcatttgattgatggaatattcagtgacgccatgtatgccctatcgcttttttctcatccatctttatgctataactcatactgatttaagaaatgatttctccttttggcaaagcgaccccattcaatatggttataataaaagactaatgtcaaactgaga

SEQ ID NO: 189637 - DNA, 757 bp, Homo sapiens
  Payload ID: 17447
  Gene Symbol: TBC1D5
  Gene Name: TBC1 domain family, member 5
  ENST ID: ENST00000428355
  CDS Start-End: 330-757
ctgttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgagggagcctgcgagcaaacgaggtggaaactggagtgcacaagtgctggaatgggctgtctgccttccacccctcacgggagggagcgcgcaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttc

SEQ ID NO: 189638 - DNA, 687 bp, Homo sapiens
  Payload ID: 17447
  Gene Symbol: TBC1D5
  Gene Name: TBC1 domain family, member 5
  ENST ID: ENST00000414349
  CDS Start-End: 356-687
cgggcccggccgcttccgcgagcgccctgcagactgagggagagagagagaaagaggaggggaggaggaggaggattcagggaataggagctggggagcccttctgcgccacagttttggagtccagaacatgtaaagttttttcacccattataaacaatttggacaaaatactgcatgttctacttaaaattgggagctaagcagtggtagagatggggcttcaccatgttgaccaggctggtcttgaactccttacctcaggtgatctcccaggcttggccttccaaggatttgtgcacatataaacttctgtccatgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaaga

SEQ ID NO: 189639 - DNA, 852 bp, Homo sapiens
  Payload ID: 17447
  Gene Symbol: TBC1D5
  Gene Name: TBC1 domain family, member 5
  ENST ID: ENST00000415814
  CDS Start-End: 302-852
acgtggccgctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacaggagggagcctgcgagcaaacgaggtggaaactggagtgcacaagtgctggaatgggctgtctgccttccacccctcacgggagggagcgcgcaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaa

SEQ ID NO: 189640 - DNA, 680 bp, Homo sapiens
  Payload ID: 17447
  Gene Symbol: TBC1D5
  Gene Name: TBC1 domain family, member 5
  ENST ID: ENST00000444471
  CDS Start-End: 584-680
ctgttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtaaatcttctatgatattgtctcagggaccacctgcagcaggagcccacaaattgaataaatgcaacataaggagaggattttttttttctgttgttgcttgtttcaaaaatgctactatccagattctctattaaggagggagcctgcgagcaaacgaggtggaaactggagtgcacaagtgctggaatgggctgtctgccttccacccctcacgggagggagcgcgcaggtagttacttttggtgacgctgtccagttcccacaatgtatcattccttatctgaaactagacatcctctgcagccagaagaacaagaagtaggcattgaccccttgtccagttactctaacaagtctggag

SEQ ID NO: 189641 - DNA, 3156 bp, Homo sapiens
  Payload ID: 17447
  Gene Symbol: TBC1D5
  Gene Name: TBC1 domain family, member 5
  Uniprot ID: Q92609
  ENST ID: ENST00000429383
  CDS Start-End: 178-2565
agcccttctgcgccacagagatggggtctcactctgtcatccaggctggaatatagtggcacaatcatagcccattgtagcctccatctcaaggactcaggggatcctcccttctaggcctcccaagtagctgggattacaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcattttgcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttcgtatcttctatccctcaaagcatcagacatgggaaaattggtttataccaagaaagcttcctctgtggaaatctgtctcagcctactttattcctgcattgggaagccatatcgcagagctaaatgcaatagaatgaaccagaactagtggattccagggctgggggaaaaaaaaaaagaaaaaa

SEQ ID NO: 189642 - DNA, 591 bp, Homo sapiens
  Payload ID: 17447
  Gene Symbol: TBC1D5
  Gene Name: TBC1 domain family, member 5
  ENST ID: ENST00000425944
  CDS Start-End: 171-591
ctgttctctttcaggtcgggccgggcccggccgcttccgcgagcgccctgcagactgagggagagagagagaaagaggaggggaggaggaggaggattcagggaataggagctggggagcccttctgcgccacaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatc

SEQ ID NO: 189643 - DNA, 3124 bp, Homo sapiens
  Payload ID: 17447
  Gene Symbol: TBC1D5
  Gene Name: TBC1 domain family, member 5
  Uniprot ID: Q92609
  ENST ID: ENST00000446818
  CDS Start-End: 265-2718
gtattgagtcaccataagtggacaaggaaggagcttctaacagacctcattgtacatacaaaattacaatcatgaatgtaaaggaaagcacactggaactgcttgcagctgactgcgaccttgagtctcagcttctgcatctgtgaaatgaagatactggtctgtgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaaggcgatgtagttacaggaagcgatgctcaggtttctgttcctgtccagactctaactgacctccaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcattttgcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttc

SEQ ID NO: 189644 - DNA, 581 bp, Homo sapiens
  Payload ID: 17447
  Gene Symbol: TBC1D5
  Gene Name: TBC1 domain family, member 5
  ENST ID: ENST00000452492
  CDS Start-End: 163-285
tttcaggtcgggccgggcccggccgcttccgcgagcgccctgcagactgagggagagagagagaaagaggaggggaggaggaggaggattcagggaataggagctggggagcccttctgcgccacaggtagttacttttggtgacgctgtccagttcccacaatgtatcattccttatctgaaactagacatcctctgcagccagaagaacaagaagtaggcattgaccccttgtccagttactctaacaagtctggaggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgatt

SEQ ID NO: 189645 - DNA, 471 bp, Homo sapiens
  Payload ID: 17447
  Gene Symbol: TBC1D5
  Gene Name: TBC1 domain family, member 5
  ENST ID: ENST00000433533
  CDS Start-End: 382-471
tattagttatgattctgttttaggaggtgtaatgccataatttcatagttttactaagtaagtttgaatttacatttgatttcttctggaagtcttagcagggtcttttaaatgaactgcatttaaaagtaaaagaatctgttgtgcttggaagatttgacagtgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtgtagttacttttggtgacgctgtccagttcccacaatgtatcattccttatctgaaactagacatcctctgcagccagaagaacaagaagtaggcattgaccccttgtccagttactctaacaag

SEQ ID NO: 189646 - DNA, 623 bp, Homo sapiens
  Payload ID: 17447
  Gene Symbol: TBC1D5
  Gene Name: TBC1 domain family, member 5
  ENST ID: ENST00000445294
  CDS Start-End: 236-623
ctgttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaagg

SEQ ID NO: 189647 - DNA, 492 bp, Homo sapiens
  Payload ID: 17447
  Gene Symbol: TBC1D5
  Gene Name: TBC1 domain family, member 5
  ENST ID: ENST00000430169
  CDS Start-End: 160-282
caggtcgggccgggcccggccgcttccgcgagcgccctgcagactgagggagagagagagaaagaggaggggaggaggaggaggattcagggaataggagctggggagcccttctgcgccacaggtagttacttttggtgacgctgtccagttcccacaatgtatcattccttatctgaaactagacatcctctgcagccagaagaacaagaagtaggcattgaccccttgtccagttactctaacaagtctggaggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaag

SEQ ID NO: 189648 - DNA, 2477 bp, Homo sapiens
  Payload ID: 17447
  Gene Symbol: TBC1D5
  Gene Name: TBC1 domain family, member 5
  ENST ID: ENST00000429924
  CDS Start-End: 172-1953
acatattcattaaatctacggaagaactgtgtccaaaaagacagccatgcgttcagaaacagtacacaactaaatatatatgttttaaaagttgcattttttagacttacttaaaattaatttcccgtagaacttctctccaagcagaggaattttaacaaaaggattctcatgctttggtttctttcatataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaaggcgatgtagttacaggaagcgatgctcaggtttctgttcctgtccagactctaactgacctccaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttggtaagtgaattactttggccctgggaacgatgagactcatcacaataatagccactagcaatactttgttctaggccttgtgctaagctgtttacatgaattaccttatttaatccttacaacagctatataatagaagtactcttactctcactctctacattatatagatgaagaaaccaaggcatagagggattaagaaaatgccccaagattatatcattagtaaatcgagtggaaattcaaaatcaagcaatccgattataagctggatgccgtggctcacagctgtaatcccagcactgtggaaagccaaggtgggaagatttgaggccaggaatttgagaccagcctgagcaacatactgagaccctgtctctaccaacacaaaacaacaaatttttttttttttaattagctgggcatggtggcacgtgcctgtagtcccagctgcccaagaggctgagatggaaatattgcttaaacccaggggtttgaggttgcagcaagttgtgattgtgccactatattc

SEQ ID NO: 189649 - DNA, 386 bp, Homo sapiens
  Payload ID: 17447
  Gene Symbol: TBC1D5
  Gene Name: TBC1 domain family, member 5
  ENST ID: ENST00000434420
  CDS Start-End: 165-386
cagtgatatcagtatcaagataaaagtttggaatgggagaaaaattctcaaagcctgaaagaaaatctccccctgctgctgttgattacacctagatctgctactgattggaactgttaaaaggcaaaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcag

SEQ ID NO: 189650 - DNA, 592 bp, Homo sapiens
  Payload ID: 17447
  Gene Symbol: TBC1D5
  Gene Name: TBC1 domain family, member 5
  ENST ID: ENST00000412981
  CDS Start-End: 222-344
gtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaaggg

SEQ ID NO: 189651 - DNA, 557 bp, Homo sapiens
  Payload ID: 17447
  Gene Symbol: TBC1D5
  Gene Name: TBC1 domain family, member 5
  ENST ID: ENST00000446863
  CDS Start-End: 320-557
gagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctagatggggtctcactctgtcatccaggctggaatatagtggcacaatcatagcccattgtagcctccatctcaaggactcaggggatcctcccttctaggcctcccaagtagctgggattacaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggc

SEQ ID NO: 189652 - DNA, 578 bp, Homo sapiens
  Payload ID: 17447
  Gene Symbol: TBC1D5
  Gene Name: TBC1 domain family, member 5
  ENST ID: ENST00000507877
  CDS Start-End: 315-578
taagtggacaaggaaggagcttctaacagacttgtgtttggagaactctattgtactgagcctaagtcatttttgatctataacaagaacatgcattttcacatgtcaaccggatttgtggaccagtaaagttctcccacaagaaatcttctatgatattgtctcagggaccacctgcagcaggagcccacaaattgaataaatgcaacataaggagaggattttttttttctgttgttgcttgtttcaaaaatgctactatccagattctctattaaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagc

SEQ ID NO: 189653 - DNA, 1027 bp, Homo sapiens
  Payload ID: 17448
  Gene Symbol: TBC1D7
  Gene Name: TBC1 domain family, member 7
  Uniprot ID: Q9P0N9
  ENST ID: ENST00000343141
  CDS Start-End: 137-880
gcatgcgcccgcccggcgcccgcccggcgacctggagttgatgtcacgtccggcggcggcggcagcggcagcggcagcggcgctgagttttgtctcccgggccgtctgggcgcgcgcgggtgtcccagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattg

SEQ ID NO: 189654 - DNA, 1116 bp, Homo sapiens
  Payload ID: 17448
  Gene Symbol: TBC1D7
  Gene Name: TBC1 domain family, member 7
  Uniprot ID: Q9P0N9
  ENST ID: ENST00000356436
  CDS Start-End: 85-966
gcggcggcggcagcggcagcggcagcggcgctgagttttgtctcccgggccgtctgggcgcgcgcgggtgtcccagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattgaaa

SEQ ID NO: 189655 - DNA, 693 bp, Homo sapiens
  Payload ID: 17448
  Gene Symbol: TBC1D7
  Gene Name: TBC1 domain family, member 7
  ENST ID: ENST00000379291
  CDS Start-End: 302-693
gcggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccgggtgtgtttgcactactagagactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatga

SEQ ID NO: 189656 - DNA, 1276 bp, Homo sapiens
  Payload ID: 17448
  Gene Symbol: TBC1D7
  Gene Name: TBC1 domain family, member 7
  Uniprot ID: Q9P0N9
  ENST ID: ENST00000379300
  CDS Start-End: 245-1126
gcggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccgggtgtgtttgcactactagagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattgaaa

SEQ ID NO: 189657 - DNA, 1084 bp, Homo sapiens
  Payload ID: 17448
  Gene Symbol: TBC1D7
  Gene Name: TBC1 domain family, member 7
  Uniprot ID: Q9P0N9
  ENST ID: ENST00000379307
  CDS Start-End: 137-937
gcatgcgcccgcccggcgcccgcccggcgacctggagttgatgtcacgtccggcggcggcggcagcggcagcggcagcggcgctgagttttgtctcccgggccgtctgggcgcgcgcgggtgtcccagaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacagtgagcattgtgttcttggcatgtgatctgggaaactgattgaataatacacttttcttgctttggtgctcaaagtggtttttttcccccaataaaattatttaattg

SEQ ID NO: 189658 - DNA, 972 bp, Homo sapiens
  Payload ID: 17448
  Gene Symbol: TBC1D7
  Gene Name: TBC1 domain family, member 7
  ENST ID: ENST00000422136
  CDS Start-End: 225-972
gcggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccggaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaag

SEQ ID NO: 189659 - DNA, 714 bp, Homo sapiens
  Payload ID: 17448
  Gene Symbol: TBC1D7
  Gene Name: TBC1 domain family, member 7
  ENST ID: ENST00000416436
  CDS Start-End: 307-714
caacagggaccgaccaaatcgtcatgcagctgtttggatgctttaaaaaaataaatccccacactcattacgcgttttatgctgctgacttttttatttttaagacatctgctcccgaaagctcagagccctttagcatttcattttctaaacgaatcctaatctttcctgtgactgaatcggttcagaggatatcttttcaataaggaaggaagccctcccctgctcactggggacgtcgcagggtttttaaacctaaagatttactcttttgtgcacagacgctggaagcatttggaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgcc

SEQ ID NO: 189660 - DNA, 1544 bp, Homo sapiens
  Payload ID: 17448
  Gene Symbol: TBC1D7
  Gene Name: TBC1 domain family, member 7
  ENST ID: ENST00000421203
  CDS Start-End: 98-637
gatgtcacgtccggcggcggcggcagcggcagcggcagcggcgctgagttttgtctcccgggccgtctgggcgcgcgcgggtgtcccagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttggaaggcataaatgttggctgactgtcaaatgcttgtgggaggtccccacggagtggagaagcgggagactcagcttaatcacagacaaagttgtgcatgagagacggagtctcactctgttgcccaggctggagttcaatggtgcaatgatctcggctcactgcaacctccgcctcttgggtgcaagtaactctcctgcctcagcctcccgagtagctgggattacaggtcccttcagagccgtgaaggcgggcatcctgtgacacagctgacacagcatggagccttcatctcctatgtgcgtttcttaggtcactctgaggggtggggccacaagctaccacctacagaattgatacctttagttcaaagccattgaccaacccaggttcatgaattttcaggcagaaggtaccaagacaaccccattaggcaactaggaagacaggccaggaaaggcctacgatgtcgtcattacagctgccaccgtcagagggttcattatgtgctcagaggtgcacagggcctcactggctgctggacagaacaggggctgctcccaggaccaggcagggtggggctggaaaccaacccaaggctctcaaagctccagggctgagccatggcatctctgtgccctgttccccaccacccaacaccgagcagttcctcaaatggctgaaagctcagaaaatcagttttaaaacaaactattggaggatgttttcttataccactagacattttttttgtttaacaatcgcaatagattaaatttaaaaaaatatttaggagaacatagttccagaatacagggaaaaataagaacctatgggaaaacaagttgatttctgaaaagtttcaaaactatgaaatgaccaacctgttagaattggtcaagtagttctttaatttgcaactatgtggc

SEQ ID NO: 189661 - DNA, 958 bp, Homo sapiens
  Payload ID: 17448
  Gene Symbol: TBC1D7
  Gene Name: TBC1 domain family, member 7
  ENST ID: ENST00000450347
  CDS Start-End: 245-958
gcggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccgggtgtgtttgcactactagagaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaat

SEQ ID NO: 189662 - DNA, 790 bp, Homo sapiens
  Payload ID: 17448
  Gene Symbol: TBC1D7
  Gene Name: TBC1 domain family, member 7
  ENST ID: ENST00000420456
  CDS Start-End: 207-790
tgctttttgggaaatgcatcagatcttttctgttcttgaaacgccaaatctaacttggtctttttttggatgaattaccgccagtattatgaaggttactgtgaaggaacttgagaccactgaactttttgagttcttgcgactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagag

SEQ ID NO: 189663 - DNA, 832 bp, Homo sapiens
  Payload ID: 17448
  Gene Symbol: TBC1D7
  Gene Name: TBC1 domain family, member 7
  ENST ID: ENST00000428109
  CDS Start-End: 364-832
caacagggaccgaccaaatcgtcatgcagctgtttggatgctttaaaaaaataaatccccacactcattacgcgttttatgctgctgacttttttatttttaagacatctgctcccgaaagctcagagccctttagcatttcattttctaaacgaatcctaatctttcctgtgactgaatcggttcagaggatatcttttcaataaggaaggaagccctcccctgctcactggggacgtcgcagggtttttaaacctaaagatttactcttttgtgcacagacgctggaagcatttggactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgac

SEQ ID NO: 189664 - DNA, 938 bp, Homo sapiens
  Payload ID: 17448
  Gene Symbol: TBC1D7
  Gene Name: TBC1 domain family, member 7
  ENST ID: ENST00000452989
  CDS Start-End: 225-938
gcggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccggaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaat

SEQ ID NO: 189665 - DNA, 762 bp, Homo sapiens
  Payload ID: 17448
  Gene Symbol: TBC1D7
  Gene Name: TBC1 domain family, member 7
  ENST ID: ENST00000446018
  CDS Start-End: 142-762
gcggcggcggcagcggcagcggcagcggcgctgagttttgtctcccgggccgtctgggcgcgcgcgggtgtcccagactcacttttccccttcgtctttctctccctttctgtctttctgtgtctcctccaagaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatc

SEQ ID NO: 189666 - DNA, 1649 bp, Homo sapiens
  Payload ID: 17448
  Gene Symbol: TBC1D7
  Gene Name: TBC1 domain family, member 7
  ENST ID: ENST00000607658
  CDS Start-End: 152-751
caggtaccccgccgcctccctccttcccgcaggactcgtccctcctggccctgggccccaacggtgcccgcctgcccggcggtcggtcagcgcacagggcacggcttcctctgcttctcccggaccacttagtctcaacccggaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagaggcaaggtttgggataaagttgtgagtggatcctgtaagatcctagtttttgtagctgtcgaaattttattaacctttaaaataaaagttatggcactgaacagtgcagagaagataacaaagtttctggaaaatgtaagtgtgctttgatttgattttgaatctggaaatgaagttaccttagcaagtcagattttcctgttacattagattatttcagagaaataattacatgattttagagaaataataccttagaatgtttcagagaataattataataatgattattttagggaaattatttaagagaaataataatttgatttgattttgaatctagaaatgaagtcactttagcaagtgagattttcctgttacattagattatttcagagaaatcatacagtgtatttttacattataagaaacacttttccctgaaaaagtttggcctaaagttggcctgagggttagtttgcatcctgtctttgggaaatgatggtctgagaccatctcgtgaatgtgtccacttagaaccagagtctcatcctccatgtgactatcagcaggcatgtcaggaaaaggaataggtgggatctgtcattttacaatgagtaatttttgtcagttcaaaaggggttctgtattttggaggattttgtaagccatttcatttctgttactgtctctggtgtagtcccagttgggtttattaatatacagtattaacctagtatattgctgaaaaaggcaatggtaatgaaattaacttttccctcgctatgtatcttggaataccctttaccaggcaagaagtaggattaaagagacttatgcctgaatgattttcacagaatccaaaatctattcatttttaaaatagtattaacatttgaaaaatggcctggtaaa

SEQ ID NO: 189667 - DNA, 2598 bp, Homo sapiens
  Payload ID: 17448
  Gene Symbol: TBC1D7
  Gene Name: TBC1 domain family, member 7
  ENST ID: ENST00000606370
  CDS Start-End: 109-603
gacctggagttgatgtcacgtccggcggcggcggcagcggcagcggcagcggcgctgagttttgtctcccgggccgtctgggcgcgcgcgggtgtcccagaatgaaatatgactgaggactctcagagaaactttcgttcagtatattatgagaaagtggggtttcgtggagttgaagaaaagaaatcattagaaattctcctaaaagatgaccgtctgggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggttagtggtcacttttgtctgacactaagctcaactctagaccgtcccatcttgccggcctttgattacatcatgttttgccttaaaaacttttggtggctccctgttgttattagaataaaagtgacacatctttacttggcattcatggccatgcacattctgacccaaccttcttactttttgtttttttaaaatacgttttattttgaagtaatttcaaacttccagaaaagttgcaagaatactaccaagaatttgcatataccctttacccagattctccagttgttaacattatgcaacttttttctacatccaacattatttaaaaagttaaaaaataaaaaattgtaggtgctaagtagctttaagcatctgttttgctttgtgtgcatctgttttgctttgttgttttaaaacgtatttttttaaacacattttttttttcctaaatcatttgagagtaagatgcagacaggattccctattacctcagattccttcagtgtacacttcctaaagacaggacacccctgtagatagccatagtacagtcctcaaaactaagacattaacattgatacaatattaacgtaatctaccagctccatttgaatttcaccaataatgccttcacaaataatcaaacggtcaaagttctgggtgaggactggatcctggtttaggcattgcactgggttatcatattgctttagtctcctttgacttgggacagttctgtctttttttatctttcatgcctttgacatttttgaagggcataatcagatgctttgaagaaagcccctccctttaggtttgtctggtgtttcctcctgattagattcaggttattcatttttggcagggataccaagtaggtgatgctgtgtccttctcagtgtctcttatcaggaggcacatagtgtgaatttgccccataagaggtagtgttaacttggatcacttggcgagggtgctgcctgctggagttttccgctggaaagtttttacttttccctttgtaattgctatttctctttgtggggagacactttaaaactgctatgtaaacatcctattccttattaaacttttgctcatgagtattctcatttgacgatttctaaaaaatttttattttttaactttttaaataatgttggatgtagaaaaaagttgcaaaaatagtgcagtgttctgaaataccttcacccagtgtcctcaaatgttacatctcatacaaccgtaatgtaatgatcaaaaccggagaatcacaatactgacagctactctgtaggcctcactgggattttgctgatgtcccactgatgctcttcttctgatccaagatccagttccggatcacacattacatttagctgccacgtcttagtctttaatctggaagagttctttttttttttttttttttcttttttttgagacagagtttttctctttttgaccaggctggagtgcagtggtgcgatcttggctcaacgcaacttctgcctcctgggttcaagcaattcttgtgcctcagcctccagagtagctgggattacaggtgcgcaccaccactcccggctaatttttgtatttttagtaaagatgggatttctccatgttggtcaggctggttttgaactcccgacctcaggtgattcacctgccttggcctcccaaagtgctgtgattactggcgtgagccactgtgcctggcctggaacagttcttcagtctttgtctttcatgaccttgacacttttgaagagccctggccagtagagcatttctcaatttgggtctgtctcatgtttctccatgattaaactctggtcacgcattattggcaggaatatcacagaagtatgggactcattactgtgctgctaactttgatcacttgggtaagatggtgtctgtggagtttctccactgtaaggttactattttcctctttgtaattaataaataactgtggagaagtactttgagacttgtaagtagccatccactaatgattcttgcctgaaccaatttttactatgctgattgccaaatggtgatctaactccttcattctttctgcatgtattagttggcattcttctctaaggaagagttttcccttctccttctttatttatatcagtatgaaattaaagtgttatttgtttggct

SEQ ID NO: 189668 - DNA, 569 bp, Homo sapiens
  Payload ID: 17448
  Gene Symbol: TBC1D7
  Gene Name: TBC1 domain family, member 7
  ENST ID: ENST00000606530
  CDS Start-End: 509-569
acttagtctcaacccgggtgtgtttgcactactagaggtgaagcatccatcatagagagaatgggacctggggtcttggaccagggtgtttttacttttcccatcaggtggacgcgcatgggcaggagatattatttgcagcatttcctcctagaggacgcctttgtcattgtagtgcaatctaagaatgggtgtccttagacaacagggaccgaccaaatcgtcatgcagctgtttggatgctttaaaaaaataaatccccacactcattacgcgttttatgctgctgacttttttatttttaagacatctgctcccgaaagctcagagccctttagcatttcattttctaaacgaatcctaatctttcctgtgactgaatcggttcagaggatatcttttcaataaggaaggaagccctcccctgctcactggggacgtcgcagggtttttaaacctaaagatttactcttttgtgcacagacgctggaagcatttggaatgaaatatgactgaggactctcagagaaactttcgttcagtatattatgagaaagtggggtttcgtg

SEQ ID NO: 189669 - DNA, 2229 bp, Homo sapiens
  Payload ID: 17448
  Gene Symbol: TBC1D7
  Gene Name: TBC1 domain family, member 7
  Uniprot ID: Q9P0N9
  ENST ID: ENST00000606214
  CDS Start-End: 15-896
tccaagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctgaacgcacccgctggttgtggaccgtctgccaggcaccacaatcattcctggacccccgagggcctctgagtttgagacgctggctgagatcaaatgataagaattccaatttttgttttcctaagtctttcatctgctaatctacccaacatgaaccacgggccacatgaagggccagacacattcttaagcggctcacagcctagaggtgcacatctgtgattacaatgtgcaaggtaaaactggatcaacagtttccaaggactggcatgtaataaaatatcctcaaaacaacaagcaagttgggcgtgacttagactttcactgcccatgtagaaggcactgtacattcttgcagcatctcagttggccagcaagaggtgagtcagaaaaaaaccattcagcagccacatggaagtggggctcactgggcacaaggcaaaactgtgaagaagataaagtgtctgtggttctgcattgactctattccctggagtcctcccctctcgagttcctagaattatgttatcactcttgctctatctcattcctatcaagacctgttttagaaatgggtgccacagactcagttacattcaaatgtaaacccattcattcatttagcaagttacttattagtgccagtgctgtgtcaggttctacattaggtaccagagtacagtgatgagcaaaaccagtccctgcccttctggaacagagaagactggaagaggatgggggtagccattaatcaaacagtcacagaaatgagtgcaaaatgtagctggagtaagggcttccatggtgaggcacttggtgcagggatctctggatctgaccaaatcaggaggtcaggaaaggcttccaggaggaagtgacactgtgcccagagctcagggatggaagaaggatgctccttctgggcagagagtaaggagagaagattggtgggaaggagggcaggggccagatgccgtgggtgtgatttggatctgtgtccctgccaatcacatgttgaattgtagtccccagtgttggaggtggagcctggtgggacatgattggatcatgggggtagtttttcatgaacggtttagtaccaaccacttggtgctgttctagtgagttgagtgcattctcgcgagatctggttgtttaaaagtgtgtagcacccttccctcttgctcctgctcctccaatgtgagactccttgctttccctctgttttccaccatgattggaagcttcctgaggcctcaccagaggcagatgccagcatcatgcttcctgtgcagcctgcagaactgtgagccaattaaacctcttttcgttat

SEQ ID NO: 189670 - DNA, 471 bp, Homo sapiens
  Payload ID: 17448
  Gene Symbol: TBC1D7
  Gene Name: TBC1 domain family, member 7
  ENST ID: ENST00000606541
  CDS Start-End: 15-471
tccaagaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctaggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggttagtggtcacttttgtctgacactaagctcaactctagaccgtcccatcttgccggcctttgattacatcatgt

SEQ ID NO: 189671 - DNA, 537 bp, Homo sapiens
  Payload ID: 17448
  Gene Symbol: TBC1D7
  Gene Name: TBC1 domain family, member 7
  ENST ID: ENST00000607230
  CDS Start-End: 277-537
gcatgcgcccgcccggcgcccgcccggcgacctggagttgatgtcacgtccggcggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccggaatgaaatatgactgaggactctcagagaaactttcgttcagtatattatgagaaagtggggtttcgtggagttgaagaaaagaaatcattagaaattctcctaaaagatgaccgtctggatactgagaaactttgtacttttagtcagaggttccctctcccgtccatgtaccgtgcattggtatggaaggtgcttctagggcttgagaagcctgcagccctgtctggttatgtaatatggaggcagcgagggaatataagcggtact

SEQ ID NO: 189672 - DNA, 3627 bp, Homo sapiens
  Payload ID: 17449
  Gene Symbol: TBC1D8
  Gene Name: TBC1 domain family, member 8 (with GRAM domain)
  Uniprot ID: O95759
  ENST ID: ENST00000376840
  CDS Start-End: 1-3423
atgtggctcaagcccgaggaggtgctgctgaagaacgcgctgaagctctgggtgacccagaagagcagctgctacttcatcctgcagcggcgccgcgggcacggcgaggggggcggccgcctcaccggtcgcctggtcggcgctctggatgcagtgttggattccaatgcacgggtcgctccatttcgaattctgcttcaagttcccggctcccaggtttattctcccatagcatgtggtgcaacattagaggaaatcaatcagcactgggactggctggaacaaaatctcctccacaccttgtctgtctttgataataaagatgacattgccagttttgtcaaagggaaggtaaaggctctgatagccgaggagaccagcagcaggctcgccgagcaggaggaggaacccgagaaattccgagaagccctggtgaagttcgaggccaggttcaacttccccgaggcggagaagctggtcacctactactcctgctgctgttggaagggcagggtgccccgccagggctggctgtacctcagcatcaaccacctctgcttctactccttcttcctgggcaaggaacttaaacttgtggttccgtgggttgatatccagaaattagaaagaacgtccaatgtctttctgacggataccatccgaatcaccacgcagaataaggagcgtgacttctccatgttcctgaacctggatgaggtgtttaaggtcatggagcagctggccgacgtgacgctgcgaaggctgctggataatgaggtctttgacctcgaccccgatctgcaggagccgagccagatcaccaagagggacctggaagccagagcacagaatgagttcttccgggctttcttcaggttgccgaggaaggagaagctgcacgcggttgtggactgttcgctctggacgccgttcagtcgctgtcacaccacggggcggatgttcgcctctgacagctacatctgctttgccagcagagaagatggctgctgtaagatcatcctgccactcagagaggtggtgagcatcgagaagatggaggacacgagcctgctgccgcatcccatcattgtcagtatcagaagcaaggtggccttccagttcattgagctccgggaccgagacagcctggtggaggcgctgcttgcgaggttgaagcaggtccacgccaaccaccccgtgcactacgacacctctgcggatgatgacatggcttcactcgtgtttcattcaacaagcatgtgcagtgaccacagatttggggatcttgaaatgatgtcttctcaaaatagcgaggagagtgagaaagagaagagcccgctgatgcaccccgatgccctggtcaccgccttccagcagtcaggcagccagagccctgactcccgaatgtccagagaacagataaaaataagcctgtggaatgaccactttgtggaatacggcagaaccgtgtgtatgtttcgcacagagaagattcggaagctcgtagccatgggcatccctgaatctttgcgagggagactctggcttctcttctcagatgcggtgacggatcttgcctcacaccctggttactacgggaatctggtggaggagtccctggggaaatgctgcctggtaaccgaggagatagaacgagacctgcaccgctccctgccagagcaccccgccttccagaacgaaacgggaattgctgctttgaggagagtcttgacggcctatgcccaccggaaccccaagattggatactgccagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagatgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaagggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtat

SEQ ID NO: 189673 - DNA, 3803 bp, Homo sapiens
  Payload ID: 17449
  Gene Symbol: TBC1D8
  Gene Name: TBC1 domain family, member 8 (with GRAM domain)
  ENST ID: ENST00000409318
  CDS Start-End: 132-3599
tcagagcgctgggcaccggccgggctgtggtccccgcgcgccgccgtcgcctctcgagcgggctcggctcacagcgaccggcggccggggagatgtgagctggggccggcgggcgcggccggaccgccgcgatgtggctcaagcccgaggaggtgctgctgaagaacgcgctgaagctctgggtgacccagaagagcagctgctacttcatcctgcagcggcgccgcgggcacggcgaggggggcggccgcctcaccggtcgcctggtcggcgctctggatgcagtgttggattccaatgcacgggtcgctccatttcgaattctgcttcaagttcccggctcccaggtttattctcccatagcatgtggtgagttactgaatggatcagacgtttactgggccatagccactggtgcaacattagaggaaatcaatcagcactgggactggctggaacaaaatctcctccacaccttgtctgtctttgataataaagatgacattgccagttttgtcaaagggaaggtaaaggctctgatagccgaggagaccagcagcaggctcgccgagcaggaggaggaacccgagaaattccgagaagccctggtgaagttcgaggccaggttcaacttccccgaggcggagaagctggtcacctactactcctgctgctgttggaagggcagggtgccccgccagggctggctgtacctcagcatcaaccacctctgcttctactccttcttcctgggcaaggaacttaaacttgtggttccgtgggttgatatccagaaattagaaagaacgtccaatgtctttctgacggataccatccgaatcaccacgcagaataaggagcgtgacttctccatgttcctgaacctggatgaggtgtttaaggtcatggagcagctggccgacgtgacgctgcgaaggctgctggataatgaggtctttgacctcgaccccgatctgcaggagccgagccagatcaccaagagggacctggaagccagagcacagaatgagttcttccgggctttcttcaggttgccgaggaaggagaagctgcacgcggttgtggactgttcgctctggacgccgttcagtcgctgtcacaccacggggcggatgttcgcctctgacagctacatctgctttgccagcagagaagatggctgctgtaagatcatcctgccactcagagaggtggtgagcatcgagaagatggaggacacgagcctgctgccgcatcccatcattgtcagtatcagaagcaaggtggccttccagttcattgagctccgggaccgagacagcctggtggaggcgctgcttgcgaggttgaagcaggtccacgccaaccaccccgtgcactacgacacctctgcggatgatgacatggcttcactcgtgtttcattcaacaagcatgtgcagtgaccacagatttggggatcttgaaatgatgtcttctcaaaatagcgaggagagtgagaaagagaagagcccgctgatgcaccccgatgccctggtcaccgccttccagcagtcaggcagccagagccctgactcccgaatgtccagagaacagataaaaataagcctgtggaatgaccactttgtggaatacggcagaaccgtgtgtatgtttcgcacagagaagattcggaagctcgtagccatgggcatccctgaatctttgcgagggagactctggcttctcttctcagatgcggtgacggatcttgcctcacaccctggttactacgggaatctggtggaggagtccctggggaaatgctgcctggtaaccgaggagatagaacgagacctgcaccgctccctgccagagcaccccgccttccagaacgaaacgggaattgctgctttgaggagagtcttgacggcctatgcccaccggaaccccaagattggatactgccagtccatgaacatcctgacctccgtgctgctgctgtacaccaaggaggaggaagccttctggctgttggttgctgtgtgtgagcggatgctgcccgattacttcaaccaccgagtgatcggggcacaagttgaccagtctgtcttcgaggagctcatcaagggtcatctcccagagctggcagagcacatgaacgacctctcagccctggcgtccgtctctctctcgtggttcctgaccctgttcctcagcatcatgcctctagagagtgcggtgaatgtggtagactgcttcttctatgatggcatcaaagccatcttccagctgggactggctgtgcttgaggccaatgctgaggacctgtgcagcagcaaggatgatggccaggccttgatgatcctcagcaggtttctagatcacattaagaatgaggacagcccagggcccccagttggcagccaccatgcctttttctccgacgaccaggagccctaccctgtgactgatatttcggacctgatccgggattcctatgagaaatttggagaccagtctgtggagcagatcgagcacctacgttacaagcacaggatcagggtcctccaaggccacgaggacaccacaaagcagaacgtgcttcgagtcgttatcccggaagtctcaattcttcctgaagacctagaggagctctacgacttattcaagagagaacatatgatgagctgttactgggagcagcccaggcccatggcctcacgccacgaccccagccggccctatgctgagcagtaccgcatagatgcccggcagtttgcacacctgtttcagctagtctcgccctggacctgcggggcccacacggagatcctcgccgaaaggacgttcaggctcttggatgacaacatggaccagctcatcgagttcaaagcgtttgtgagctgcctcgatattatgtataatggagaaatgaatgagaagattaaactattatacaggcttcatatccctccagcactcactgaaaatgaccgagacagccagtcgccgttgaggaatcctctgttgtcaacatcgagacccctggttttcgggaaacccaatggtgatgcagttgattatcagaaacagctgaagcagatgattaaggatttagccaaagaaaaagataaaactgagaaagaattgcccaaaatgagccagagagaatttatccagttctgtaaaactctgtacagtatgttccatgaagatccagaagaaaatgatttgtatcaagccatcgccacagtcaccacactgctgctgcagatcggggaggtggggcagcgaggcagcagctctggaagctgctcccaggagtgtggggaggagctgcgggcttcagctccttctcctgaggactcggtttttgcagacactgggaagacgccccaggactcccaggcatttccagaggcggcagaaagggactggactgtctcccttgaacatattttagcttcacttctgactgaacagtcattagtcaacttttttgaaaagccactggacatgaaatccaaacttgaaaatgccaagatcaatcagtacaatctcaaaacttttgaaatgagccaccaatcacaatctgaacttaagctgagtaacttgtagcaagacagcagctgctatgcacactggagtccaccataccaaagcacgaaccagactgtttcttggggtcagccctaaaccgagatttcagtctaccttaccaatggggcatctggctaaacaacctgacaaactgtggccaggggaaccgacacaaccctcaagcatttctatgtattgagaattgtcagtgccctaaggtat

SEQ ID NO: 189674 - DNA, 3538 bp, Homo sapiens
  Payload ID: 17450
  Gene Symbol: TBC1D8B
  Gene Name: TBC1 domain family, member 8B (with GRAM domain)
  ENST ID: ENST00000276175
  CDS Start-End: 42-3386
gggcatctaggtcactgctcccggggggcacaaagttcgcgatgtggctgaagcctgaggaagtgcttctgaaaaatgcgctgaagctgtggctgatggaaaggtccaacgactacttcgtgctgcagcggcgtcggggctacggggaggaaggcggaggggggctcacagggcttctggttgggactcttgattcagtcttggactctactgctaaagtagctccatttcgcatcctacaccagacaccagattctcaagtttacttgtcaattgcatgtggagccaacagagaagaaataaccaagcattgggattggttggaacaaaatattatgaagaccttatctgtatttgattcaaatgaagatattactaattttgtacaaggaaaaataagaggattaattgctgaagagggaaaacattgttttgcaaaagaagatgatcctgagaaatttcgagaagcccttttgaaatttgaaaaatgttttggtttaccagagaaggagaagttagtgacctattattcatgcagttattggaaaggacgggttccttgtcagggttggctttatcttagcaccaactttctgagcttctattcttttttgttgggatcagaaataaaactcattatctcctgggatgaagtctcaaaacttgaaaagacttcaaatgtcatactgacagagagtattcacgtgtgttcccaaggagagaatcactacttttcaatgtttttgcacattaaccaaacataccttcttatggaacagctggcaaactatgccattagaagactttttgataaggaaacatttgataatgacccagtcctttataatcctctacagatcaccaaaagaggtctggaaaatagagcccacagtgagcaatttaatgccttttttaggctgcccaaaggagagagtttgaaagaagtacatgaatgtttcttatgggtaccattcagccacttcaatactcatgggaaaatgtgcatctcagaaaattatatctgctttgctagccaagatggcaatcagtgtagtgtaatcattccactacgagaggtcttagctatagataagacaaatgattccagcaaatctgtcatcattagcatcaaaggaaaaacagcttttcgcttccatgaagttaaagactttgaacaactggtagcaaaactcaggctcagatgcggagcagcttcaactcaatatcatgatattagcacagagtctacagagccatctgataattttgaggtgcaatctttgacaagtcagagggaatgcagtaaaactgtgaacactgaagccttaatgacagtatttcaccctcagaatttggagactcttaattctaaaatgttgaaagaaaaaatgaaggaacagtcatggaaaatactgtttgcagaatgtggacgtggtgttagtatgtttcgaaccaaaaagactcgagatcttgttgtaagagggattccagaaacattaagaggagaactctggatgcttttttcaggtgctgttaatgacatggctactaatcctgactattatactgaagtggttgagcagtccttagggacctgcaacttggctactgaagaaattgaacgtgatttacgtcgctctctgcctgagcacccagcctttcagagtgatactggcatatctgctctgagaagggtactcacagcttatgcatacaggaatcccaaaattggatactgccaggcaatgaatattttgacttcagtgctgcttctatatgcaaaagaggaagaagctttttggcttctggttgctgtatgtgaacgaatgttgcctgattattttaatcgtcgaattattggtgccttggtggatcaggcagtctttgaagaacttatcagggatcaccttcctcagctgacagaacacatgactgatatgacattcttttcctcagtttctctctcttggtttctcacactttttattagtgtgctacctattgaaagtgcagtgaatgtggtggactgtttcttctatgatggaataaaggccattttgcaactgggattggcaatacttgactataatttagacaaactgctgacttgtaaagatgatgctgaagctgtgacagccttaaacaggttctttgacaatgtcactaataaggatagtccattgccttcaaatgttcagcaaggttcaaatgtgagtgatgaaaaaaccagtcatactagagtggatattacagatttgattagagaatcaaatgagaaatatggtaatattcgctatgaagatatacatagtatgcgctgtcgaaataggttgtatgtgatacagaccctagaggaaacaacaaaacagaatgtgttgcgtgttgtatcacaagatgtgaaattgagccttcaagaattggatgaactttatgtcatctttaagaaagagctgtttttatcttgttattggtgtttgggttgcccagtattgaagcatcatgaccccagtctgccatatttggaacagtatcagattgactgccagcagttcagagcgttgtatcacttgttgagtccctgggctcattctgcaaataaagactcactagctttatggacattcagattgttagatgaaaactctgattgccttataaacttcaaagaattctcctctgcaattgacataatgtacaatggaagttttactgagaagcttaagctgctttttaagctacatattcctccagcttacactgaagtgaaatctaaggatgcttcaaaaggagatgaactttccaaggaagaattactttatttcagtcagctgcatgtttccaagcctgcaaatgagaaggaagcagaatcagcaaaacacagccctgaaaaaggcaaagggaaaattgatattcaagcatatctaagtcaatggcaagatgagcttttcaaaaaagaagaaaacattaaggatttaccaagaatgaatcagtctcagtttattcagttttcaaagaccctctataacttatttcatgaggaccctgaagaagaatcattatatcaagccattgctgttgtaaccagccttttactcaggatggaagaagttggaaggaaactacatagccctacatcatcagccaaaggattctctggtactgtctgtggttctggaggacccagtgaggaaaaaacagggagccacttggagaaagatccttgttcctttagggaggaacctcagtggtcatttgcatttgaacagattcttgcatcgctgttgaatgaaccagcattggtgaggttttttgagaaacccatagatgtaaaagccaagctggaaaatgcaagaatttctcagttaaggtctagaaccaagatgtaaatccctaggaattgcctatcatagacaagtttactaacattcctgtagctgtcagtttgattcctgtgagtagggctcagggatttatcttgttaccaatgtgtctgaaggccaaaatatatatccagaagcacaatgcatcattcctttgt

SEQ ID NO: 189675 - DNA, 2589 bp, Homo sapiens
  Payload ID: 17450
  Gene Symbol: TBC1D8B
  Gene Name: TBC1 domain family, member 8B (with GRAM domain)
  Uniprot ID: Q0IIM8
  ENST ID: ENST00000310452
  CDS Start-End: 166-2064
acgtgggagagaagggagggttgggggaagtgtggaaaacctgaacctgagctgctgtcgcctgaggaagatttggtgggaggagaagcagaggggaagagacgggttgagagtgaggtgaggagggcatctaggtcactgctcccggggggcacaaagttcgcgatgtggctgaagcctgaggaagtgcttctgaaaaatgcgctgaagctgtggctgatggaaaggtccaacgactacttcgtgctgcagcggcgtcggggctacggggaggaaggcggaggggggctcacagggcttctggttgggactcttgattcagtcttggactctactgctaaagtagctccatttcgcatcctacaccagacaccagattctcaagtttacttgtcaattgcatgtggagccaacagagaagaaataaccaagcattgggattggttggaacaaaatattatgaagaccttatctgtatttgattcaaatgaagatattactaattttgtacaaggaaaaataagaggattaattgctgaagagggaaaacattgttttgcaaaagaagatgatcctgagaaatttcgagaagcccttttgaaatttgaaaaatgttttggtttaccagagaaggagaagttagtgacctattattcatgcagttattggaaaggacgggttccttgtcagggttggctttatcttagcaccaactttctgagcttctattcttttttgttgggatcagaaataaaactcattatctcctgggatgaagtctcaaaacttgaaaagacttcaaatgtcatactgacagagagtattcacgtgtgttcccaaggagagaatcactacttttcaatgtttttgcacattaaccaaacataccttcttatggaacagctggcaaactatgccattagaagactttttgataaggaaacatttgataatgacccagtcctttataatcctctacagatcaccaaaagaggtctggaaaatagagcccacagtgagcaatttaatgccttttttaggctgcccaaaggagagagtttgaaagaagtacatgaatgtttcttatgggtaccattcagccacttcaatactcatgggaaaatgtgcatctcagaaaattatatctgctttgctagccaagatggcaatcagtgtagtgtaatcattccactacgagaggtcttagctatagataagacaaatgattccagcaaatctgtcatcattagcatcaaaggaaaaacagcttttcgcttccatgaagttaaagactttgaacaactggtagcaaaactcaggctcagatgcggagcagcttcaactcaatatcatgatattagcacagagcttgctattagttctgagtctacagagccatctgataattttgaggtgcaatctttgacaagtcagagggaatgcagtaaaactgtgaacactgaagccttaatgacagtatttcaccctcagaatttggagactcttaattctaaaatgttgaaagaaaaaatgaaggaacagtcatggaaaatactgtttgcagaatgtggacgtggtgttagtatgtttcgaaccaaaaagactcgagatcttgttgtaagagggattccagaaacattaagaggagaactctggatgcttttttcaggtgctgttaatgacatggctactaatcctgactattatactgaagtggttgagcagtccttagggacctgcaacttggctactgaagaaattgaacgtgatttacgtcgctctctgcctgagcacccagcctttcagagtgatactggcatatctgctctgagaagggtactcacagcttatgcatacaggaatcccaaaattggatactgccaggcaatgaatattttgacttcagtgctgcttctatatgcaaaagaggaagaagctttttggcttctggttgctgtatgtgaacgaatgttgcctgattattttaatcgtcgaattattggttcagatgattttatgccactagtaagaatccaaggacaatgtgttattggggagaagtagaaaaaggaaaatctggggtagcacctggcatgctctttctccaattttctactacttactcctattccccaaattctcccatcaaggaggaaatgaactctgagacagaagatgagttttcctcaaagcttgaccaggatataagtggatgccttattgggcaaagcagagggtaaccaattagaaggccctggcttctcttgattgatagctgagaactcatcagagggatcagtgctttctctgtgtattgctggagtctgaaagtgtgactctcatgtcactgattcatttctgaagtgttaaattcagaataaatttttgataatcaaaatgaacttagagaactttgttgtttggcattgtcaagagtgaagaattctaattatttgtgtatttatcttgtgttatgctagatattaaactccctgaacatgagactatttcattaattggtatagctcttataatacctagtacaggtctctgcatataataaagactcaataaataactcttcaaatg

SEQ ID NO: 189676 - DNA, 5717 bp, Homo sapiens
  Payload ID: 17450
  Gene Symbol: TBC1D8B
  Gene Name: TBC1 domain family, member 8B (with GRAM domain)
  Uniprot ID: Q0IIM8
  ENST ID: ENST00000357242
  CDS Start-End: 175-3537
tctctgcctacgtgggagagaagggagggttgggggaagtgtggaaaacctgaacctgagctgctgtcgcctgaggaagatttggtgggaggagaagcagaggggaagagacgggttgagagtgaggtgaggagggcatctaggtcactgctcccggggggcacaaagttcgcgatgtggctgaagcctgaggaagtgcttctgaaaaatgcgctgaagctgtggctgatggaaaggtccaacgactacttcgtgctgcagcggcgtcggggctacggggaggaaggcggaggggggctcacagggcttctggttgggactcttgattcagtcttggactctactgctaaagtagctccatttcgcatcctacaccagacaccagattctcaagtttacttgtcaattgcatgtggagccaacagagaagaaataaccaagcattgggattggttggaacaaaatattatgaagaccttatctgtatttgattcaaatgaagatattactaattttgtacaaggaaaaataagaggattaattgctgaagagggaaaacattgttttgcaaaagaagatgatcctgagaaatttcgagaagcccttttgaaatttgaaaaatgttttggtttaccagagaaggagaagttagtgacctattattcatgcagttattggaaaggacgggttccttgtcagggttggctttatcttagcaccaactttctgagcttctattcttttttgttgggatcagaaataaaactcattatctcctgggatgaagtctcaaaacttgaaaagacttcaaatgtcatactgacagagagtattcacgtgtgttcccaaggagagaatcactacttttcaatgtttttgcacattaaccaaacataccttcttatggaacagctggcaaactatgccattagaagactttttgataaggaaacatttgataatgacccagtcctttataatcctctacagatcaccaaaagaggtctggaaaatagagcccacagtgagcaatttaatgccttttttaggctgcccaaaggagagagtttgaaagaagtacatgaatgtttcttatgggtaccattcagccacttcaatactcatgggaaaatgtgcatctcagaaaattatatctgctttgctagccaagatggcaatcagtgtagtgtaatcattccactacgagaggtcttagctatagataagacaaatgattccagcaaatctgtcatcattagcatcaaaggaaaaacagcttttcgcttccatgaagttaaagactttgaacaactggtagcaaaactcaggctcagatgcggagcagcttcaactcaatatcatgatattagcacagagcttgctattagttctgagtctacagagccatctgataattttgaggtgcaatctttgacaagtcagagggaatgcagtaaaactgtgaacactgaagccttaatgacagtatttcaccctcagaatttggagactcttaattctaaaatgttgaaagaaaaaatgaaggaacagtcatggaaaatactgtttgcagaatgtggacgtggtgttagtatgtttcgaaccaaaaagactcgagatcttgttgtaagagggattccagaaacattaagaggagaactctggatgcttttttcaggtgctgttaatgacatggctactaatcctgactattatactgaagtggttgagcagtccttagggacctgcaacttggctactgaagaaattgaacgtgatttacgtcgctctctgcctgagcacccagcctttcagagtgatactggcatatctgctctgagaagggtactcacagcttatgcatacaggaatcccaaaattggatactgccaggcaatgaatattttgacttcagtgctgcttctatatgcaaaagaggaagaagctttttggcttctggttgctgtatgtgaacgaatgttgcctgattattttaatcgtcgaattattggtgccttggtggatcaggcagtctttgaagaacttatcagggatcaccttcctcagctgacagaacacatgactgatatgacattcttttcctcagtttctctctcttggtttctcacactttttattagtgtgctacctattgaaagtgcagtgaatgtggtggactgtttcttctatgatggaataaaggccattttgcaactgggattggcaatacttgactataatttagacaaactgctgacttgtaaagatgatgctgaagctgtgacagccttaaacaggttctttgacaatgtcactaataaggatagtccattgccttcaaatgttcagcaaggttcaaatgtgagtgatgaaaaaaccagtcatactagagtggatattacagatttgattagagaatcaaatgagaaatatggtaatattcgctatgaagatatacatagtatgcgctgtcgaaataggttgtatgtgatacagaccctagaggaaacaacaaaacagaatgtgttgcgtgttgtatcacaagatgtgaaattgagccttcaagaattggatgaactttatgtcatctttaagaaagagctgtttttatcttgttattggtgtttgggttgcccagtattgaagcatcatgaccccagtctgccatatttggaacagtatcagattgactgccagcagttcagagcgttgtatcacttgttgagtccctgggctcattctgcaaataaagactcactagctttatggacattcagattgttagatgaaaactctgattgccttataaacttcaaagaattctcctctgcaattgacataatgtacaatggaagttttactgagaagcttaagctgctttttaagctacatattcctccagcttacactgaagtgaaatctaaggatgcttcaaaaggagatgaactttccaaggaagaattactttatttcagtcagctgcatgtttccaagcctgcaaatgagaaggaagcagaatcagcaaaacacagccctgaaaaaggcaaagggaaaattgatattcaagcatatctaagtcaatggcaagatgagcttttcaaaaaagaagaaaacattaaggatttaccaagaatgaatcagtctcagtttattcagttttcaaagaccctctataacttatttcatgaggaccctgaagaagaatcattatatcaagccattgctgttgtaaccagccttttactcaggatggaagaagttggaaggaaactacatagccctacatcatcagccaaaggattctctggtactgtctgtggttctggaggacccagtgaggaaaaaacagggagccacttggagaaagatccttgttcctttagggaggaacctcagtggtcatttgcatttgaacagattcttgcatcgctgttgaatgaaccagcattggtgaggttttttgagaaacccatagatgtaaaagccaagctggaaaatgcaagaatttctcagttaaggtctagaaccaagatgtaaatccctaggaattgcctatcatagacaagtttactaacattcctgtagctgtcagtttgattcctgtgagtagggctcagggatttatcttgttaccaatgtgtctgaaggccaaaatatatatccagaagcacaatgcatcattcctttgttgttgataatgggctttgttagcactttttaaaacaaacaaacaaacaaaacaaaaaagcaaaccacatttgttatctcaaattttgatgatattctcaaatacaaatatacttttttatatttcacaatatatgcaatatcaggggaatatgctaaatgttaccaccagagggcacaagcatatcacttttagtaaggaaattactagcttgtgttgctatttacatatgaattactgattattttgaaaagacggtgttatgcttgggtgttagtgaggctgatatgtcatgtcaatcgataaaccctactttccaaattatctaaaagattaccatttggggcccttgttttcaagttatctaactgaaatattattaatttttttaagttaatctcattcagtcttctagtaataaatgcttttttaagtaccttctacagtcttcctacctgaggggttcagaggctgctgactcacactgctaactctgttactgacaaaagcaaatcaataactctaaattctgggctgatataaagaaaaaaacaatattggatttggatttaatctgggtaaaatcagccttctgagaagggctaagaaacagttcaattaactgtataggtctttcattagaccgagacatcactagaaattctgggcactgctgtttgtggtatttgtctcagagtagcttatgactgttttggttctagctttagattttggattttcaccagtcatgtgttaatttacattagatagtaaagaatggctacactaagactgaattatcttattagtctggcaagcatataaagtatacttgtatgtaatgattgccaaggtaacagaattgctgacatctgtctaaaaagttttgactatccaatttagatgtgtaatttctatatactttatgctgtttatatttcagtcattacaccaagtccatttagagataatgggctttgttagcactttcaaaaaaaaaaaaagcaaaccatacttgtccactgtcctgtgctattcctaccaaggacaatttattaatcaattgacttagaaaatagggggagaaatcattcattggagcttctttctttagaaaagactttggttataagccttttgacttttctagatgtgaaaccatgaaagggcagacctccttcagagtgactcaagaggtctccctttcttggagggagttggtacagtcagcctttgggaagaatccactgtgaacaaagcttaacacatggggcttcatcgctcatagaatatgttattttcaaagaagttcaagaattttcaagttgagcctttgaaaatcccataaattggttttagctaaacacttactagtagtgtctttaaattatttaatcaaccttgtcttttcaaggaaattaccacttaaagagatagttggtaaataaacatctatgccttttctcagaaatgatttgctgaactatgtccatattttacagcttagataatagtttatatggaaactattatacatctgctattgtgcaatgattgttaaattatactgaagtagctctagaaagacacatgtatacaaggcactattgtacacactttgctgaatattttgtcagttgtatttacaaagaaaggtactttcttaagagcatatatgttattaatatttgatatgattttaaagtcagaatagtacagattgctgagtattatactttaggctagattaattaaaattgaatactgaaagagattttttgagttgcaaaaagtttataaatgcaaagcaaaaagaaaacatttattttctgagtctgcaggagaaacaaactaaacattatagttttatagctgctatcttgttaaccaaacaggttgttcataatattaaaaatcttacgtagttgtgttaaactgaaccagttcattataccttatgcattaaattaaatatgttataaggtggctttacttgtctttataaaaataaatatatctactaaacatg

SEQ ID NO: 189677 - DNA, 654 bp, Homo sapiens
  Payload ID: 17450
  Gene Symbol: TBC1D8B
  Gene Name: TBC1 domain family, member 8B (with GRAM domain)
  ENST ID: ENST00000431860
  CDS Start-End: 1-654
tttcaataggttctttgacaatgtcactaataaggatagtccattgccttcaaatgttcagcaaggttcaaatgtgagtgatgaaaaaaccagtcatactagagtggatattacagatttgattagagaatcaaatgagttgcgtgttgtatcacaagatgtgaaattgagccttcaagaattggatgaactttatgtcatctttaagaaagagctgtttttatcttgttattggtgtttgggttgcccagtattgaagcatcatgaccccagtctgccatatttggaacagtatcagattgactgccagcagttcagagcgttgtatcacttgttgagtccctgggctcattctgcaaataaagactcactagctttatggacattcagattgttagatgaaaactctgattgccttataaacttcaaagaattctcctctgcaattgacataatgtacaatggaagttttactgagaagcttaagctgctttttaagctacatattcctccagcttacactgaagtgaaatctaaggatgcttcaaaaggagatgaactttccaaggaagaattactttatttcagtcagctgcatgtttccaagcctgcaaatgagaaggaagcagaatcagcaaaacacagccctgaaaa

SEQ ID NO: 189678 - DNA, 4098 bp, Homo sapiens
  Payload ID: 17450
  Gene Symbol: TBC1D8B
  Gene Name: TBC1 domain family, member 8B (with GRAM domain)
  ENST ID: ENST00000481617
  CDS Start-End: 150-1409
agggttgggggaagtgtggaaaacctgaacctgagctgctgtcgcctgaggaagatttggtgggaggagaagcagaggggaagagacgggttgagagtgaggtgaggagggcatctaggtcactgctcccggggggcacaaagttcgcgatgtggctgaagcctgaggaagtgcttctgaaaaatgcgctgaagctgtggctgatggaaaggtccaacgactacttcgtgctgcagcggcgtcggggctacggggaggaaggcggaggggggctcacagggcttctggttgggactcttgattcagtcttggactctactgctaaagtagctccatttcgcatcctacaccagacaccagattctcaagtttacttgtcaattgcatgtggagccaacagagaagaaataaccaagcattgggattggttggaacaaaatattatgaagaccttatctgtatttgattcaaatgaagatattactaattttgtacaaggaaaaataagaggattaattgctgaagagggaaaacattgttttgcaaaagaagatgatcctgagaaatttcgagaagcccttttgaaatttgaaaaatgttttggtttaccagagaaggagaagttagtgacctattattcatgcagttattggaaaggacgggttccttgtcagggttggctttatcttagcaccaactttctgagcttctattcttttttgttgggatcagaaataaaactcattatctcctgggatgaagtctcaaaacttgaaaagacttcaaatgtcatactgacagagagtattcacgtgtgttcccaaggagagaatcactacttttcaatgtttttgcacattaaccaaacataccttcttatggaacagctggcaaactatgccattagaagactttttgataaggaaacatttgataatgacccagtcctttataatcctctacagatcaccaaaagaggtctggaaaatagagcccacagtgagcaatttaatgccttttttaggctgcccaaaggagagagtttgaaagaagtacatgaatgtttcttatgggtaccattcagccacttcaatactcatgggaaaatgtgcatctcagaaaattatatctgctttgctagccaagatggcaatcagtgtagtgtaatcattccactacgagaggtcttagctatagataagacaaatgattccagcaaatctgtcatcattagcatcaaaggaaaaacagcttttcgcttccatgaagttaaagactttgaacaactggtagcaaaactcaggctcagatgcggagcagcttcaactcaatatcatgatattagcacagaggtaattaattatacagcaatcaaatcatttggaaaaaaaggtgtgtgtttagtgtagcccattcttcaagaggaattcatagtacctttcctatttatgcccaggggttttttttaaagatagaatctaagaaattatattgtctaactcacatccttaagcagaagtgagaattaaggactttattcatttttaggaacccatacattataaaattactataatttgatctttcttttactctatttgctgtttaccatataaatataccttgtactttcacatagtttggtttttaagaagtcaaaatatatttgagaattcagtgaggcctcgaaaaaggactcctcttactgttgcaaagacatagcaattttaaacctgtctggatatcttttatttaatatcttataggtcagccttatttacataatctggccaaaagcaaaatagtggtatatctgtttactagtaaaatattagagaggacagagaaatcaggaaagatccaaaattgacaccctaacatcacaattaaaagaactagaaaagcaagagcaaacactttcaaaagctagcagaaggcaagaaataactaaaatcagagcagaactgaaggaaatagagacacaaaaaacccttcaaaaaattaacgaatccacaagctggttttttgaaaggatcaacaaaattgatagaccactagcaagactaataaagaaaaaaagagagaagaatcaaatacacgcaataaaaaatgataaaggggatatcacgaccaatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagcttaacaacgaaaaagagcccaggaccagatggattcacagccgaattctaccagaggtacaaggaggaactggtaccattccttctgaaactattccaatcaatagaaaaagagggaatcctccctaacccattttatgaggccagcatcatcctgataccaaagccgggcagagacacaactaaaaaagagaattttggaccaatatccttgatgaacattgatgcaaaaatcctcaataaaatactggcaagccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatctcaaaatcataagagctatctatgacaaacccacagccaatatcatactgaatgggcaaaaactggaagcattcccttttgaaaactggcacaagacagggatgccctctctcaccactcctattcaacatagtgttggaagttctggccagggcaattaggcaggagaaggaaataaagagtattcaattaggaaaagaggaagtcaaattgtccctgtttgcagacgacatgattgtatatctagaaaaccccatagtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaatagaatacctaggaatccaacttacaagggatgtgaaggacctcttcaaggagaactacaaaccactactcaaggaaataaaagaggatacaaacaaatagaagaaaattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcatcgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatacctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcgttaccattcagtacataggcatgggcaaggacttcatgtctaaaacaccaaaagcaatggcaacaaaagccaaaattgacaaatgggatctaattaaactaaagagcttctgcacagcaaaagaaacaaccatcagagtgaacaggcaacctacaaaatgggagaaatttttctcaacctacttatctgacaaagggctaatatccagaatctacaatgaactc

SEQ ID NO: 189679 - DNA, 496 bp, Homo sapiens
  Payload ID: 17450
  Gene Symbol: TBC1D8B
  Gene Name: TBC1 domain family, member 8B (with GRAM domain)
  ENST ID: ENST00000460545
  CDS Start-End: 431-496
agtgctgcagatacattttgagatttggacaattgaagctgacttaactcttttattgaaagataattttctcagatactactcacattggcatactgtaatctctctttatcccaaatgtattttttctttaagaaaaatctctgtaaggactctatgggctagaaaagttttaaaataaatttattagtttgttatatgaagtgatacagatttgatttatctcttgtaaagtccttatttcaacaatctttctattacaacagggcttctggttgggactcttgattcagtcttggactctactgctaaagtagctccatttcgcatcctacaccagacaccagattctcaagtttacttgtcaattgcatgtggagccaacagagaagaaataaccaagcattgggattggttggaacaaaatattatgaagaccttatctgtatttgattcaaatgaagatattactaattttgtacaaggaaaaataaga

SEQ ID NO: 189680 - DNA, 5306 bp, Homo sapiens
  Payload ID: 17451
  Gene Symbol: TBC1D9
  Gene Name: TBC1 domain family, member 9 (with GRAM domain)
  Uniprot ID: Q6ZT07
  ENST ID: ENST00000442267
  CDS Start-End: 76-3876
gcgcgcctgtcgcggtggtgggtgcaggactggacccacgggcccattgtgcgcccgcccgcggcagccaggaccatgtgggtgaacccggaggaggtgttgctggccaacgcgctgtggatcaccgagagggccaacccatacttcatcctgcagcggaggaagggccacgccggcgatggaggcggcggcggcggactggcgggcctgctggtgggtacccttgatgttgtgttggactccagcgcccgggtcgctccttaccgaatcttgtaccagactccagactccctggtctactggaccatcgcctgtggtggttccaggaaagaaatcactgaacactgggaatggcttgagcaaaatctcttgcagacactctccatctttgaaaatgagaatgatatcaccacatttgtgagaggaaaaatacagggcatcattgcagaatacaacaaaatcaatgatgtaaaggaagatgatgacacggagaagtttaaagaagccattgtgaaatttcataggctgtttgggatgccagaggaagagaaactcgtcaactattactcttgcagctattggaaggggaaggtcccccgtcagggttggatgtacctcagcattaaccacctttgcttttattcttttcttatgggaagggaagcgaaactggtcatccggtgggtagacatcactcagcttgagaagaatgccaccctgcttctgcctgatgtgatcaaagtgagcacacggtccagtgagcatttcttctctgtattcctcaacatcaacgagaccttcaagttaatggagcagcttgccaacatagccatgaggcaactcttagacaatgagggatttgaacaagatcgatccctgcccaaactcaaaaggaaatctcctaaaaaagtgtctgctctaaaacgtgatcttgatgccagggcaaagagtgagagataccgtgcacttttccggctgcccaaagatgaaaaattagatggccacacagactgcactctctggactccatttaacaaaatgcacattttggggcagatgtttgtgtccacaaattacatctgttttaccagcaaggaggagaacttatgtagcctcattatcccgctccgtgaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtgccatcaatgagaaggccacacatcctgggtactatgaagacctagtggagaagtccatggggaagtataatctcgccacggaggagattgagagggatttacaccgctcccttccagaacacccagcttttcagaatgaaatgggcattgctgcactaaggagagtcttaacagcttatgcttttcgaaatcccaacatagggtattgccaggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccacgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctgacacgggcgccttcccgggggagtgggaggagagggaggggagggattttttatgttcttctgtgttgagttttttctttctttcttttaaattaaatatttattagtacctggcttgaagcctagtgttttcataatgtaattcaatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatatttttaagatttgaaatatatttcatagaagtcctctattcaaaatcatattccacagatgttccccttcaaagggaaaacatttggggttctaaacagttatgaaagtaagtgatttttacatgattccagaataacacttgtattgaccaatttagacagataccagaccaattttgcatttaagaaattgttctgattatttacgtcaactcattagaattcagtgaaaagtaacagtcttttgtcacagagaatctgaaagtagcagcaaagacagagggctcatgacaggtttttgcttttgctttgcttttgtttttgaaagagtaaaagtactgatgcttctgatactggatgtttagcttcttactgcaaaaacataagtaaaacagtcaactttaccatttccgtattctccatagattgaagaaatttataccacatatcgcatatgaccatctttccatcaaatcaatgtagagataatgtaaactgaaaaaaaatctgcaagataatgtaactgaatgttttaaaaacagaacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgatttttaaactgtcaaatgaagtagtgttaacctcaaataggctaaatgtgaacaaataaaatacagcaaatactcagatacagctttttatcttt

SEQ ID NO: 189681 - DNA, 5119 bp, Homo sapiens
  Payload ID: 17452
  Gene Symbol: TBC1D9B
  Gene Name: TBC1 domain family, member 9B (with GRAM domain)
  Uniprot ID: Q66K14
  ENST ID: ENST00000355235
  CDS Start-End: 36-3737
ctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaaaagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattacaggctctcagatctgcccttgcttgcctcatacctctgtgctccacactgcggccaggccagctgagtccctccatccgtggatgctttcctgcagctatgtggtatgggggtcattcctgcctcttggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaatgaaa

SEQ ID NO: 189682 - DNA, 5173 bp, Homo sapiens
  Payload ID: 17452
  Gene Symbol: TBC1D9B
  Gene Name: TBC1 domain family, member 9B (with GRAM domain)
  Uniprot ID: Q66K14
  ENST ID: ENST00000356834
  CDS Start-End: 39-3791
cgtctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagcatctcctctggcctcagatctggatcttttcctgccctgggaggctcaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaaaagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattacaggctctcagatctgcccttgcttgcctcatacctctgtgctccacactgcggccaggccagctgagtccctccatccgtggatgctttcctgcagctatgtggtatgggggtcattcctgcctcttggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaatgaaa

SEQ ID NO: 189683 - DNA, 668 bp, Homo sapiens
  Payload ID: 17452
  Gene Symbol: TBC1D9B
  Gene Name: TBC1 domain family, member 9B (with GRAM domain)
  ENST ID: ENST00000522472
  CDS Start-End: 1-499
ggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctg

SEQ ID NO: 189684 - DNA, 927 bp, Homo sapiens
  Payload ID: 17452
  Gene Symbol: TBC1D9B
  Gene Name: TBC1 domain family, member 9B (with GRAM domain)
  ENST ID: ENST00000524222
  CDS Start-End: 1-197
acaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccacaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaaaagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggc

SEQ ID NO: 189685 - DNA, 532 bp, Homo sapiens
  Payload ID: 17452
  Gene Symbol: TBC1D9B
  Gene Name: TBC1 domain family, member 9B (with GRAM domain)
  ENST ID: ENST00000522224
  CDS Start-End: 32-334
cgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtgggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaa

SEQ ID NO: 189686 - DNA, 2755 bp, Homo sapiens
  Payload ID: 17452
  Gene Symbol: TBC1D9B
  Gene Name: TBC1 domain family, member 9B (with GRAM domain)
  ENST ID: ENST00000519746
  CDS Start-End: 144-1373
cgcccatcctgggaaggggcccggagtgtgagagagagactcccccacgcccatcctggaaaggagcccggagtgtgagctgagtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaaaagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattacaggctctcagatctgcccttgcttgcctcatacctctgtgctccacactgcggccaggccagctgagtccctccatccgtggatgctttcctgcagctatgtggtatgggggtcattcctgcctcttggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaatgaaa

SEQ ID NO: 189687 - DNA, 303 bp, Homo sapiens
  Payload ID: 17452
  Gene Symbol: TBC1D9B
  Gene Name: TBC1 domain family, member 9B (with GRAM domain)
  ENST ID: ENST00000630103
  CDS Start-End: 1-303
atgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtgggaatcatcgcagaagagaacaagaacctgcagccccagggagacgaggaccccgggaagttcaaggaggctga

SEQ ID NO: 189688 - DNA, 2441 bp, Homo sapiens
  Payload ID: 17453
  Gene Symbol: TBCCD1
  Gene Name: TBCC domain containing 1
  Uniprot ID: Q9NVR7
  ENST ID: ENST00000338733
  CDS Start-End: 130-1803
aggagggtgaggggcgggcccagcgagcggacgccgggcgcggcggcgcgcggagaagtgcggcggagcggcgcctgcattagcaggtatgcaaagaagccttttcaccctgatgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaagacacctgaggagcgcctggaatggtctgaggttctgtccaactgcatgtctgaggaggaagttgaaaagcagagaaatcagctttcagtggacacgctacagtttctgctcttcttatacattcaacagttgaacaaggtctccctaaggacatctttgattggcgaagagtggcccagtcccagaaacaaatctcagtctcctgacctgactgaaaaatctaattgtcataataagaactggaatgattacagtcaccaagcttttgtctatgatcatctgtctgatctcctcgagctgcttttagatccaaaacaactcactgcatcatttcattcaacccatagtagtctagtgtctcgagaagctgttgtggcgctcagcttccttattgaaggtacaataagtagagccaggaagatctatccacttcatgaacttgcactgtggcaaccactgcatgcagatagtggcttctcaaagatctctaagactttctctttctacaaactggaaacctggttgaggtcctgtttgactgggaatccatttggtacatcagcttgcctcaagtctggaaagaaattggcttgggctcatcaagttgaagggaccaccaaaagagctaagattgcttgtaatactcatgtggcccctaggatgcaccgactggtagtgatgagccaggtttacaagcagacactggctaagagctcagacactctggcgggggcacatgtaaagattcatcgttgcaacgaatcttttatatatctgctctctcccttacgatctgtgacaattgagaagtgcaggaatagcatctttgtcttgggccctgtagggactacacttcacctccacagttgtgacaatgttaaagtcattgctgtttgccatcgtttgtccatctcttctacaacaggttgcatctttcacgttcttacgcctacacgcccacttattctctctgggaaccagacagtaacttttgccccttttcatacacattacccaatgctagaggaccatatggccaggactggccttgctacagtgcctaactattgggataatccaatggttgtgtgcagagagaacagcgacacaagagtcttccagcttttaccaccttgtgaattctatgtatttattattccctttgaaatggaaggggacacaacagagatacccgggggtcttccatctgtatatcagaaagcactgggtcaaagagaacagaagatacagatctggcagaaaactgtgaaggaggctcatttgacaaaggatcaaaggaagcagttccaggtactggtagagaacaagttttatgaatggttgattaatacaggacatcgccaacagctggacagccttgtaccccctgcagcaggctccaaacaagcagctggataaggatcttacatgcagacactgggccctggaaatacaaggataaatggaggatggtgctcatcttgaaacttgaaactaaattgggaaggtgctattgctgcttaagagacattgggacttttctgtctttttttttttttttttttgaggcagagtcttgttctgtcgcccaggctggagtgcagtggcgcgatctcggctcactgcaagctctgcctcccgggttcacgccattctcctgcctcagcctcctgagtagctgggactacaggcgcccgccaccacgcccggccaattttttttgtatttttagtagagacggggtttcaccgtgttagtcaggatggtctcgatttcctgacctcgtgatccgcccatctcggcctcccaaagtgctgggattacaggcgtgagccaccgtgcccagccttctgttctatttaagaactttgatttccattccattttcatttattactgtttaggccgaattttcgctaaacttctgactttcatataaacatattgcttatagaacatcagaagactcgtctttgtgatgcccaaatgaaaaagttggtgaaggtagtaccattgtatgtatgttaatattaaagcaactgagtgtagatttgcaa

SEQ ID NO: 189689 - DNA, 1158 bp, Homo sapiens
  Payload ID: 17453
  Gene Symbol: TBCCD1
  Gene Name: TBCC domain containing 1
  ENST ID: ENST00000413695
  CDS Start-End: 481-1158
acgtcagagggtcgcgccgctgcaggaacccgctctgcctgagctaccgcgagtcgtagaaaattacgtaatgatagggggccggtcagagtgagggcacctgaggtacacgaaatccctccggcttgcccacttcctcggactttccaccaatcaggagcttcctccccagcaccaaccaattgtgggagagaagttttctctgtgctacaagcccggaatttcattcatacccagctacgctccgaatgagggagcagaggtacagcggccgaatgagcgggaacagttattccacgacaggtgtacatcagacgcattgcttaggcctcttattttacgttctccaagcaactccataagacaactgtctcggaaaggctacagtgatgacagaccgacttaagttcggattcggcttccaccgcttcttagtggtatgcaaagaagccttttcaccctgatgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaagacacctgaggagcgcctggaatggtctgaggttctgtccaactgcatgtctgaggaggaagttgaaaagcagagaaatcagctttcagtggacacgctacagtttctgctcttcttatacattcaacagttgaacaaggtctccctaaggacatctttgattggcgaagagtggcccagtcccagaaacaaatctcagtctcctgacctgactgaaaaatctaattgtcataataagaactggaatgattacagtcaccaagcttttgtctatgatcatctgtctgatctcctcgagctgcttttagatccaaaacaactcactgcatcatttcattcaacccatagtagtctagtgtctcgagaagctgttgtggcgctcagcttccttattgaaggtacaataagtagagccaggaagatc

SEQ ID NO: 189690 - DNA, 2186 bp, Homo sapiens
  Payload ID: 17453
  Gene Symbol: TBCCD1
  Gene Name: TBCC domain containing 1
  Uniprot ID: Q9NVR7
  ENST ID: ENST00000446782
  CDS Start-End: 165-1550
attcatacccagctacgctccgaatgagggagcagaggtacagcggccgaatgagcgggaacagttattccacgacaggtgtacatcagacgcattgcttaggcctcttattttacgttctccaagcaactccataagacaactgtctcggaaaggctacagtgatgacagaccgacttaagttcggattcggcttccaccgcttcttagtgctttcagtggacacgctacagtttctgctcttcttatacattcaacagttgaacaaggtctccctaaggacatctttgattggcgaagagtggcccagtcccagaaacaaatctcagtctcctgacctgactgaaaaatctaattgtcataataagaactggaatgattacagtcaccaagcttttgtctatgatcatctgtctgatctcctcgagctgcttttagatccaaaacaactcactgcatcatttcattcaacccatagtagtctagtgtctcgagaagctgttgtggcgctcagcttccttattgaaggtacaataagtagagccaggaagatctatccacttcatgaacttgcactgtggcaaccactgcatgcagatagtggcttctcaaagatctctaagactttctctttctacaaactggaaacctggttgaggtcctgtttgactgggaatccatttggtacatcagcttgcctcaagtctggaaagaaattggcttgggctcatcaagttgaagggaccaccaaaagagctaagattgcttgtaatactcatgtggcccctaggatgcaccgactggtagtgatgagccaggtttacaagcagacactggctaagagctcagacactctggcgggggcacatgtaaagattcatcgttgcaacgaatcttttatatatctgctctctcccttacgatctgtgacaattgagaagtgcaggaatagcatctttgtcttgggccctgtagggactacacttcacctccacagttgtgacaatgttaaagtcattgctgtttgccatcgtttgtccatctcttctacaacaggttgcatctttcacgttcttacgcctacacgcccacttattctctctgggaaccagacagtaacttttgccccttttcatacacattacccaatgctagaggaccatatggccaggactggccttgctacagtgcctaactattgggataatccaatggttgtgtgcagagagaacagcgacacaagagtcttccagcttttaccaccttgtgaattctatgtatttattattccctttgaaatggaaggggacacaacagagatacccgggggtcttccatctgtatatcagaaagcactgggtcaaagagaacagaagatacagatctggcagaaaactgtgaaggaggctcatttgacaaaggatcaaaggaagcagttccaggtactggtagagaacaagttttatgaatggttgattaatacaggacatcgccaacagctggacagccttgtaccccctgcagcaggctccaaacaagcagctggataaggatcttacatgcagacactgggccctggaaatacaaggataaatggaggatggtgctcatcttgaaacttgaaactaaattgggaaggtgctattgctgcttaagagacattgggacttttctgtctttttttttttttttttttgaggcagagtcttgttctgtcgcccaggctggagtgcagtggcgcgatctcggctcactgcaagctctgcctcccgggttcacgccattctcctgcctcagcctcctgagtagctgggactacaggcgcccgccaccacgcccggccaattttttttgtatttttagtagagacggggtttcaccgtgttagtcaggatggtctcgatttcctgacctcgtgatccgcccatctcggcctcccaaagtgctgggattacaggcgtgagccaccgtgcccagccttctgttctatttaagaactttgatttccattccattttcatttattactgtttaggccgaattttcgctaaacttctgactttcatataaacatattgcttatagaacatcagaagactcgtctttgtgatgcccaaatgaaaaagttggtgaaggtagtaccattgtatgtatgttaatattaaagcaactgagtgtagatttgc

SEQ ID NO: 189691 - DNA, 460 bp, Homo sapiens
  Payload ID: 17453
  Gene Symbol: TBCCD1
  Gene Name: TBCC domain containing 1
  ENST ID: ENST00000430560
  CDS Start-End: 17-460
tgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaagacacctgaggagcgcctggaatggtctgaggttctgtccaactgcatgtctgaggaggaagttgaaaagcagagaaatcagttgaacaaggtctccctaaggacatctttgattggcgaagagtggcccagtcccagaaacaaatctcagtctcctgacctgactgaaaaatctaattgtcataataag

SEQ ID NO: 189692 - DNA, 3058 bp, Homo sapiens
  Payload ID: 17453
  Gene Symbol: TBCCD1
  Gene Name: TBCC domain containing 1
  Uniprot ID: Q9NVR7
  ENST ID: ENST00000424280
  CDS Start-End: 481-2154
acgtcagagggtcgcgccgctgcaggaacccgctctgcctgagctaccgcgagtcgtagaaaattacgtaatgatagggggccggtcagagtgagggcacctgaggtacacgaaatccctccggcttgcccacttcctcggactttccaccaatcaggagcttcctccccagcaccaaccaattgtgggagagaagttttctctgtgctacaagcccggaatttcattcatacccagctacgctccgaatgagggagcagaggtacagcggccgaatgagcgggaacagttattccacgacaggtgtacatcagacgcattgcttaggcctcttattttacgttctccaagcaactccataagacaactgtctcggaaaggctacagtgatgacagaccgacttaagttcggattcggcttccaccgcttcttagtggtatgcaaagaagccttttcaccctgatgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaagacacctgaggagcgcctggaatggtctgaggttctgtccaactgcatgtctgaggaggaagttgaaaagcagagaaatcagctttcagtggacacgctacagtttctgctcttcttatacattcaacagttgaacaaggtctccctaaggacatctttgattggcgaagagtggcccagtcccagaaacaaatctcagtctcctgacctgactgaaaaatctaattgtcataataagaactggaatgattacagtcaccaagcttttgtctatgatcatctgtctgatctcctcgagctgcttttagatccaaaacaactcactgcatcatttcattcaacccatagtagtctagtgtctcgagaagctgttgtggcgctcagcttccttattgaaggtacaataagtagagccaggaagatctatccacttcatgaacttgcactgtggcaaccactgcatgcagatagtggcttctcaaagatctctaagactttctctttctacaaactggaaacctggttgaggtcctgtttgactgggaatccatttggtacatcagcttgcctcaagtctggaaagaaattggcttgggctcatcaagttgaagggaccaccaaaagagctaagattgcttgtaatactcatgtggcccctaggatgcaccgactggtagtgatgagccaggtttacaagcagacactggctaagagctcagacactctggcgggggcacatgtaaagattcatcgttgcaacgaatcttttatatatctgctctctcccttacgatctgtgacaattgagaagtgcaggaatagcatctttgtcttgggccctgtagggactacacttcacctccacagttgtgacaatgttaaagtcattgctgtttgccatcgtttgtccatctcttctacaacaggttgcatctttcacgttcttacgcctacacgcccacttattctctctgggaaccagacagtaacttttgccccttttcatacacattacccaatgctagaggaccatatggccaggactggccttgctacagtgcctaactattgggataatccaatggttgtgtgcagagagaacagcgacacaagagtcttccagcttttaccaccttgtgaattctatgtatttattattccctttgaaatggaaggggacacaacagagatacccgggggtcttccatctgtatatcagaaagcactgggtcaaagagaacagaagatacagatctggcagaaaactgtgaaggaggctcatttgacaaaggatcaaaggaagcagttccaggtactggtagagaacaagttttatgaatggttgattaatacaggacatcgccaacagctggacagccttgtaccccctgcagcaggctccaaacaagcagctggataaggatcttacatgcagacactgggccctggaaatacaaggataaatggaggatggtgctcatcttgaaacttgaaactaaattgggaaggtgctattgctgcttaagagacattgggacttttctgtctttttttttttttttttttgaggcagagtcttgttctgtcgcccaggctggagtgcagtggcgcgatctcggctcactgcaagctctgcctcccgggttcacgccattctcctgcctcagcctcctgagtagctgggactacaggcgcccgccaccacgcccggccaattttttttgtatttttagtagagacggggtttcaccgtgttagtcaggatggtctcgatttcctgacctcgtgatccgcccatctcggcctcccaaagtgctgggattacaggcgtgagccaccgtgcccagccttctgttctatttaagaactttgatttccattccattttcatttattactgtttaggccgaattttcgctaaacttctgactttcatataaacatattgcttatagaacatcagaagactcgtctttgtgatgcccaaatgaaaaagttggtgaaggtagtaccattgtatgtatgttaatattaaagcaactgagtgtagatttgcaactatagtgtgtatcttcatttgtgtgatgaaagagttttattctttctagagttaaataagagttttatagttctttgtaactatttaaaaggaaattgctactccttttaaaaaataattggaaaggaagtatgatttgttggtatatagacatagaaatagttttatactatattttagtccttaaagtatggaacttaatgaaattgtttaaaaaaatctttatttttcacttcctgcttcaaattttcaataaacaaactct

SEQ ID NO: 189693 - DNA, 4121 bp, Homo sapiens
  Payload ID: 17454
  Gene Symbol: TBKBP1
  Gene Name: TBK1 binding protein 1
  Uniprot ID: A7MCY6
  ENST ID: ENST00000361722
  CDS Start-End: 850-2697
gagagaagtacacacgcaccccctcactgcctactcctgctttcgggagcctgagtcattcctgccccctcgtagggttccccatttcccggtgcgcgggcaccctgagacagccttgggaattcgttcgcgtccccttccacctgggtccccttccccagtttgcgccccgtaacactcagccaaggacttcctgtgggtcccaggtcaggggccaaggggtcctggaccgctgccacagccccggtgcgcccgggggaggcgcttccttttcctgaactctgggatcctgcgggaggaagtggggaagttgggcgggggtgcagccgagggcgtgccgactgtggaggggccgaccctcgcgcagctctgggccttccttggggaggagctggggtgccagaggcccaggctgaggagcttggcggcgaggtatttggggaagtaaggcctggggtggagaagcgcggaggaatgggccgggcccggctgggaaggcagccctctcccatccacaggtctccctgggttctggcaggagcctgcccctgctgccggcctggcttacttgtccctacttgtcaacaccctggcagcggggtcttcacctggttccagccccttttccccaaggcggcagagaggatggggctgaggagtctgggaaggggccatgggagtccctgctgagctcggggcaggaagtttctgggttgcatcttagccggccccagggagtgcagagccagggagaggggtaccagggacaaaccctagacagacggccctgtccacggttgctcctgctctcctaggaggccccgtgtgggccgcggcccggccctcaccatggagtccatgttcgaggacgacatcagcatcctgacgcaggaggccctggggcctagtgaggtgtggctggacagtcccggagacccctcgcttgggggcgacatgtgctccgcctcccactttgccctcatcactgcttacggagacatcaaggaacggctggggggcctggagagggagaacgccaccctccgacgccgcctcaaagtctacgagatcaagtacccactgatcagtgactttggagaggagcatggcttttctctgtatgaaatcaaggatggctccctgctggaggtggagaaggtcagcctgcagcaacggctcaaccagttccagcatgagttacagaagaacaaggagcaggaagaacagcttggagagatgatccaggcctacgagaaactctgcgtggagaagagtgacttggagacagagctgagggagatgagggccctggtggagacgcacctgcgtcagatctgtggtttggagcagcagctgcggcaacagcaaggcctccaggatgcagccttctccaacctgagcccaccgccagcccccgcccctccctgcactgatttagacctgcactacctggcactgagagggggatctggcttgagtcatgcaggctggccgggctccacacccagtgtgagtgacctggagcggcggcggctagaagaggctttggaggccgcgcagggagaggcccggggggctcagctccgggaggagcagctccaggccgagtgcgagcggctgcagggggagctgaagcagctgcaggagacccgggcccaggatctggcctccaaccagtcggagcgagacatggcgtgggtgaaaagagttggggatgatcaggtgaatttggcgctggcctacaccgagctgacggaggagctgggccggcttcgggagttgagttccctacaggggagaatcttgaggactctgttgcaggaacaggcccggagtggcggccagaggcactcgccgctgtcacaacgccactccccggccccccagtgcccctccccctccccgcctgcccgagcggctcccccgtgccccccgtgccagtcccccgtcccccagcgccgctctcccgtgcccccgtgcccctcgccgcagcagcgccgctctccggcctcaccctcctgcccgtcgcccgtcccgcagcgccgctcgccggtgccgccgtcgtgccagtcccccagcccgcagcgccgttccccggtgccccccagctgcccggccccgcagccccggccaccgccgccgcccccgccgggcgagaggacgctggccgagcgcgcctacgccaagccgcccagccaccacgtgaaggccggcttccagggccgccgcagctactctgagctggcggagggcgcggcctacgcgggcgcctccccgccctggctgcaggccgaagcggccactctccccaagccccgggcctacggcagcgagctctacggccctggcaggcccctcagcccgcggcgcgccttcgagggcatccggctgcgcttcgagaagcagccgtcggaggaggacgagtgggctgtgcccaccagcccgcccagcccggaggtgggcaccatccgctgcgcctccttctgcgcgggcttccccatccccgagtcgcccgccgccaccgcctacgcccacgccgagcacgcgcagtcctggccgtccatcaacttgctgatggagacggtgggctccgacatccgcagctgccccctctgccagctgggtttccctgtcgggtacccggatgatgccctcatcaaacacattgactcccacctggagaacagcaagatctagggcaccagccccacccactggctgtttctccgtcctctcctatcacccccaaacactcactttgaatgctgcatgaatctcgtggggggtccctgcccttgcgacccccagatacctccacttgctaccgagtcaacgtgtgtgccatcttccctggtccaggcaccactcagctctggctcttcctgggaggtcagccgaggctccccccatgctcctggtttctgcttaggaggtggggacttgggctgggatggggacggcatacccctcccaggcctctccctctgcctttctgttcttaatcagggttggatccaagaaggtgtccagtgcttgggcctggggtggggggaaggtgttagaggactccaggagctcctgcacccctccccaaatgtccatctttctcagacggggctctgtctggggagcacccacaggctgcctttggggtcccagagcctgctctgtgcactgaccccagttcctccatcctgtggccagcctagggctcatggcatgggcccccactgggggagggaggcatcttgtttcttgtggttccctgcaggccagtcctgtcctcctttccctgttctgcccactctggggaatagggaggggaggagaggagaggagagggaggatcctggaggactgggaagatctagcctaaagaggcttctctgagggccagggccctacagcatgcccctacggccaggggactgtctgccagcctcccaggcccatgccctcctggtgcccctggcactgaggcacagatcgtcaaggcaggtaccccctcaacccttcttccactggagcccctgacaccacaggtgccctggagcccttgtgtgactcagcctctgttagctgggtgggtgtcatcagcccctgcctcccaggccagaacctgagaacgggcccagggtgctgtggagatcaacttcaaaagagctaaccccttcccacactccacccacccacctacatttcctctgtgaaatctacctcagagttgtaccctcagaaggacgggtaagcaggaggccagggggtccccagggctgaggtggggagccttctacggcgaaagcctgccaccccacaatgaatccaccctgctccactgcgcgcctctcccaggtctcagctctgggtggggagcagtggccgctaccgacagcgcatgtcccgctcttatccaactcttccaggccccacctccctgcacccctcccctctatagagcaggggagtgaaggggtatgtcaggcggggaaggggccaaggacacgtcattgtaccctgagcgtccccagggagtggaaatggggaagggggcctggagaggggaggcaggggcccctgtgctctctgaacaagttgaaagtccaaataaaacttacctgttc

SEQ ID NO: 189694 - DNA, 705 bp, Homo sapiens
  Payload ID: 17454
  Gene Symbol: TBKBP1
  Gene Name: TBK1 binding protein 1
  ENST ID: ENST00000537587
  CDS Start-End: 80-705
gggcgctgggcccagagaggaatgcggaggaaggaggcatttgtggaggccccgtgtgggccgcggcccggccctcaccatggagtccatgttcgaggacgacatcagcatcctgacgcaggaggccctggggcctagtgaggtgtggctggacagtcccggagacccctcgcttgggggcgacatgtgctccgcctcccactttgccctcatcactgcttacggagacatcaaggaacggctggggggcctggagagggagaacgccaccctccgacgccgcctcaaagtctacgagatcaagtacccactgatcagtgactttggagaggagcatggcttttctctgtatgaaatcaaggatggctccctgctggaggtggagaaggtcagcctgcagcaacggctcaaccagttccagcatgagttacagaagaacaaggagcaggaagaacagcttggagagatgatccaggcctacgagaaactctgcgtggagaagagtgacttggagacagagctgagggagatgagggccctggtggagacgcacctgcgtcagatctgtggtttggagcagcagctgcggcaacagcaaggcctccaggatgcagccttctccaacctgagcccaccgccagcccccgcccctccctgcactgatttagacctgcactacctggcactgagagggggatctggctt

SEQ ID NO: 189695 - DNA, 733 bp, Homo sapiens
  Payload ID: 17454
  Gene Symbol: TBKBP1
  Gene Name: TBK1 binding protein 1
  ENST ID: ENST00000578982
  CDS Start-End: 149-733
gacagggcgaggagcagagcgcggtaccaggggggtgggggcactggtgcccgtttggggagggagcaggcggagggggtaagctgcgattacaagcaggaaccggcagcagctgaggccccgtgtgggccgcggcccggccctcaccatggagtccatgttcgaggacgacatcagcatcctgacgcaggaggccctggggcctagtgaggtgtggctggacagtcccggagacccctcgcttgggggcgacatgtgctccgcctcccactttgccctcatcactgcttacggagacatcaaggaacggctggggggcctggagagggagaacgccaccctccgacgccgcctcaaagtctacgagatcaagtacccactgatcagtgactttggagaggagcatggcttttctctgtatgaaatcaaggatggctccctgctggaggtggagaaggtcagcctgcagcaacggctcaaccagttccagcatgagttacagaagaacaaggagcaggaagaacagcttggagagatgatccaggcctacgagaaactctgcgtggagaagagtgacttggagacagagctgagggagatgagggccctggtggagacgcacctgcgtcagatctgtggtttggagcagcagctgcggcaacagcaaggcctccaggatgcagccttctccaacctgagcccaccgccagcccccgcccctccctgcactgat

SEQ ID NO: 189696 - DNA, 2010 bp, Homo sapiens
  Payload ID: 17454
  Gene Symbol: TBKBP1
  Gene Name: TBK1 binding protein 1
  Uniprot ID: A7MCY6
  ENST ID: ENST00000622396
  CDS Start-End: 429-1097
ttggcggcgaggtatttggggaagtaaggcctggggtggagaagcgcggaggaatgggccgggcccggctgggaaggcagccctctcccatccacaggtctccctgggttctggcaggagcctgcccctgctgccggcctggcttacttgtccctacttgtcaacaccctggcagcggggtcttcacctggttccagccccttttccccaaggcggcagagaggatggggctgaggagtctgggaaggggccatgggagtccctgctgagctcggggcaggaagtttctgggttgcatcttagccggccccagggagtgcagagccagggagaggggtaccagggacaaaccctagacagacggccctgtccacggttgctcctgctctcctaggaggccccgtgtgggccgcggcccggccctcaccatggagtccatgttcgaggacgacatcagcatcctgacgcaggaggccctggggcctagtgaggtgtggctggacagtcccggagacccctcgcttgggggcgacatgtgctccgcctcccactttgccctcatcactgcttacggagacatcaaggaacggctggggggcctggagagggagaacgccaccctccgacgccgcctcaaagtctacgagatcaagtacccactgatcagtgactttggagaggagcatggcttttctctgtatgaaatcaaggatggctccctgctggaggtggagaaggtcagcctgcagcaacggctcaaccagttccagcatgagttacagaagaacaaggagcaggaagaacagcttggagagatgatccaggcctacgagaaactctgcgtggagaagagtgacttggagacagagctgagggagatgagggccctggtggagacgcacctgcgtcagatctgtggtttggagcagcagctgcggcaacagcaaggcctccaggatgcagccttctccaacctgagcccacgccgagcacgcgcagtcctggccgtccatcaacttgctgatggagacggtgggctccgacatccgcagctgccccctctgccagctgggtttccctgtcgggtacccggatgatgccctcatcaaacacattgactcccacctggagaacagcaagatctagggcaccagccccacccactggctgtttctccgtcctctcctatcacccccaaacactcactttgaatgctgcatgaatctcgtggggggtccctgcccttgcgacccccagatacctccacttgctaccgagtcaacgtgtgtgccatcttccctggtccaggcaccactcagctctggctcttcctgggaggtcagccgaggctccccccatgctcctggtttctgcttaggaggtggggacttgggctgggatggggacggcatacccctcccaggcctctccctctgcctttctgttcttaatcagggttggatccaagaaggtgtccagtgcttgggcctggggtggggggaaggtgttagaggactccaggagctcctgcacccctccccaaatgtccatctttctcagacggggctctgtctggggagcacccacaggctgcctttggggtcccagagcctgctctgtgcactgaccccagttcctccatcctgtggccagcctagggctcatggcatgggcccccactgggggagggaggcatcttgtttcttgtggttccctgcaggccagtcctgtcctcctttccctgttctgcccactctggggaatagggaggggaggagaggagaggagagggaggatcctggaggactgggaagatctagcctaaagaggcttctctgagggccagggccctacagcatgcccctacggccaggggactgtctgccagcctcccaggcccatgccctcctggtgcccctggcactgaggcacagatcgtcaaggcaggtaccccctcaacccttcttccactggagcccctgacaccacaggtgccctggagcccttgtg

SEQ ID NO: 189697 - DNA, 1465 bp, Homo sapiens
  Payload ID: 17455
  Gene Symbol: TBX1
  Gene Name: T-box 1
  Uniprot ID: O43435
  ENST ID: ENST00000329705
  CDS Start-End: 130-1326
ccggcagggggagcgaggaggaagggaaccgcggccgggccagcggaggcggcggagcgcaccgcccaccagggctcagggtcctccgaccgggtgaagcttcgctggctgccaggatccccggcagggatgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcggatcacgcagctcaagattgccagcaatcccttcgcgaaaggcttccgggactgtgaccctgaggactggccccggaaccaccggcccggcgcactgccgctcatgagcgccttcgcgcgctcgcggaaccccgtggcttccccgacgcagcccagcggcacggagaaaggtggacatgtcctgaaggacaaggaagtgaaagctgagacgtctaggaacacaccagagagagaagtggagcttctgagggatgcaggtggctgtgtgaacctggggctcccctgccccgcagagtgccaacccttcaatacccagggcctggtggctgggaggaccgcaggtgaccgtctttgttgaatgctgaggccgggccatgggcacatggagttgtcgtgtttcccttcactttggttcatgtttgaaatttccaaaattaaaaaaacagtgacttgttcagtaaattccaatatgaataaagtgcatgttttgtaataaa

SEQ ID NO: 189698 - DNA, 2084 bp, Homo sapiens
  Payload ID: 17455
  Gene Symbol: TBX1
  Gene Name: T-box 1
  Uniprot ID: O43435
  ENST ID: ENST00000332710
  CDS Start-End: 130-1617
ccggcagggggagcgaggaggaagggaaccgcggccgggccagcggaggcggcggagcgcaccgcccaccagggctcagggtcctccgaccgggtgaagcttcgctggctgccaggatccccggcagggatgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcggatcacgcagctcaagattgccagcaatcccttcgcgaaaggcttccgggactgtgaccctgaggactggccccggaaccaccggcccggcgcactgccgctcatgagcgccttcgcgcgctcgcggaaccccgtggcttccccgacgcagcccagcggcacggagaaagacgcggctgaggcccggcgagaattccagcgcgacgcgggcgggccagcagtgctcggggacccggcgcatcctccgcagctgctggcccgggtgctaagcccctcgctgcccggggccggcggcgccggcggcttagtcccgctgcccggcgcgcccggaggccggcccagtcccccgaaccccgagctgcgcctggaggcgcccggcgcatcggagccgctgcaccaccacccctacaaatatccggccgccgcctacgaccactatctcggggccaagagccggccggcgccctacccgctgcccggcctgcgtggccacggctaccacccgcacgcgcatccgcaccaccaccaccaccccgtgagtccagccgccgcggccgccgccgccgctgccgcagctgccgcggccgccaacatgtactcgtcggccggagccgcgccgcccggctcctacgactattgccccagataacacgggccctgtcgcgctcccgccccggtcctgcacagccccgaagttcgccgggcccggccaccctgccccaagggcaagcaaggaatacgttcccccagccccaggggccaccgcggctctccccttccccagcctcgaagccatgggggccccctcgccacccccagccccttgggctatcgaagtatccggttccccagtccctggagccaccgcgggtccttccccggccccgagggccaagggggtccccgcccgccagtgccaaagcgcccggtcggaggcggaaggaagtgatatttattgttctccccgagaccgcgtcgcccgcggcccggccggcagttgcagtgtagacagcccgagagccccgcctgcaggcggtgtagatacatgtagatactgtagatactgtagataccgccccggcgccgacttgataaacggtttcgcctcttttggaa

SEQ ID NO: 189699 - DNA, 1538 bp, Homo sapiens
  Payload ID: 17455
  Gene Symbol: TBX1
  Gene Name: T-box 1
  Uniprot ID: O43435
  ENST ID: ENST00000359500
  CDS Start-End: 130-1248
ccggcagggggagcgaggaggaagggaaccgcggccgggccagcggaggcggcggagcgcaccgcccaccagggctcagggtcctccgaccgggtgaagcttcgctggctgccaggatccccggcagggatgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcggatcacgcagctcaagattgccagcaatcccttcgcgaaaggcttccgggactgtgaccctgaggactggccccggaaccaccggcccggcgcactgccgctcatgagcgccttcgcgcgctcgcggaaccccgtggcttccccgacgcagcccagcggcacggagaaagggctggtcacagaaggctctgggctccaacctggcttgctggacgtgctcttgaagcccccaagtaagaagtctgagtccctgagaccaccacactgcaaggacacttgaaggtactcaggtttcagagcccaagtcaggaggtcaagtgtgcatgcaagaggtggcaggggacagatgtgctgctgttcccaggccacctgcacagctggatggtggaagcagttcacttaaaggccatgagttactcgggaggctgaggcaggaggatcacttgagcctattagttggaggctgcagtaagctatgatcatgccactgcactccagcctgggtgacagagtgagacccccactgtccctggtctcttaaaagaaaaaacaaacaaacaaaccaaaaaa

SEQ ID NO: 189700 - DNA, 1248 bp, Homo sapiens
  Payload ID: 17455
  Gene Symbol: TBX1
  Gene Name: T-box 1
  Uniprot ID: O43435
  ENST ID: ENST00000621939
  CDS Start-End: 130-1248
ccggcagggggagcgaggaggaagggaaccgcggccgggccagcggaggcggcggagcgcaccgcccaccagggctcagggtcctccgaccgggtgaagcttcgctggctgccaggatccccggcagggatgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcggatcacgcagctcaagattgccagcaatcccttcgcgaaaggcttccgggactgtgaccctgaggactggccccggaaccaccggcccggcgcactgccgctcatgagcgccttcgcgcgctcgcggaaccccgtggcttccccgacgcagcccagcggcacggagaaagggctggtcacagaaggctctgggctccaacctggcttgctggacgtgctcttgaagcccccaagtaagaagtctgagtccctgagaccaccacactgcaaggacacttga

SEQ ID NO: 189701 - DNA, 1548 bp, Homo sapiens
  Payload ID: 17456
  Gene Symbol: TBX10
  Gene Name: T-box 10
  Uniprot ID: O75333
  ENST ID: ENST00000335385
  CDS Start-End: 89-1246
acgagtggtgaccaccccttccagcaggcaggttcccagccccagccaagcagtgtttctccaggagccggacagcctctctgtctccatggcagccttcctatctgctggcctcggcatacttgcaccctcagagacctaccccctacctacaaccagctctggctgggagccccggctggggtcaccattcccatcaggcccttgcaccagctctactggggcccaagctgtggccgagcccactgggcagggccccaagaacccacgtgtgtccagagtgacagttcagctggagatgaagcctctgtgggaggaattcaaccagctgggcactgagatgatcgtcaccaaggcaggcaggaggatgttcccccccttccaggtgaagatcctgggcatggactccctggccgactacgccctgctcatggacttcatccccctggacgacaagagatacaggtatgccttccacagctcggcctggctggtggcgggcaaggcagacccagccacacctggccgcgtgcacttccaccccgactcgccagccaagggtgcccagtggatgcgccagattgtgtcctttgacaagctcaagctgaccaacaacctgctggatgacaatggccacatcattctcaactctatgcaccgctaccagccccgtttccacgtggtcttcgtggacccacgcaaggacagtgagcgctatgcccaggagaacttcaagtccttcatcttcacagagacccagttcacagcagtgacagcctatcagaaccacaggatcacccagctgaaaatcgccagcaacccttttgccaaaggctttagagagagtgacctggactcctggcctgtggccccacggcccctgctcagtgtcccagcccggagtcacagcagcctcagtccctgtgtgctgaagggtgccacagacagggagaaagaccccaacaaagcttcagcttccacctccaagacccctgcttggctccatcatcagctgctgcccccacctgaggtcctgctggccccggccacctacaggcctgtcacgtatcagagcctgtactctggagccccgagccacctagggatcccaaggacccgaccagcaccataccccctccccaacatccgggctgatagggatcaaggaggcctgcctctcccagctgggctggggctcctgtcccccactgtggtgtgcctggggcctggccaggactcccagtgatgccagaagccctggggggaagccctgctaccctggaccttacaccgggtgtgggaatcagcctctgccccgccccctccagccccatctctgtctcaaggagagcagggtaggtgaaagtctagagaaagaggctacctgcccagggtcacagcaaggctgggaccatggcaagcttggaaccaggacttctatctcccaaccccagcagcctgaatactgtgccctcttgctttgggggtaactcccgaaaaccctgccttacctctcccttccccctaacattaaactatttggcatga

SEQ ID NO: 189702 - DNA, 3492 bp, Homo sapiens
  Payload ID: 17457
  Gene Symbol: TBX15
  Gene Name: T-box 15
  Uniprot ID: Q96SF7
  ENST ID: ENST00000207157
  CDS Start-End: 316-1806
tctttccggcttctttgcaaaaggatagaaccgtctcgaccagggcactaggactggaagatcgggctgtgtctaggccgctgtccgcgaaatccgagacgttttttcagcttggctaggaccgacttcgctgccggtttgagctttctctgcactcgggggtctcctgccgtcctcgaccggtggcgtaacttgggaagagattctgagcagagcactggttcagattctgaggtcctcactgagcggacttcctgctccttcagtactcacactgacctggcctctggtgctgcaggccctgtgcctgctgccatgtcttccatggaggagattcaggtggagctgcaatgtgctgacctctggaagcggttccatgatattggaactgaaatgatcatcaccaaagcaggcaggaggatgtttcctgccatgagagtgaaaatcactggcctagatccacatcagcagtactacatagcaatggacattgtgcctgtggacaataaaagatacagatatgtgtatcatagctccaagtggatggtggctggcaatgctgattcccctgtgcccccaagagtttatatacaccctgattctctagcttctggagacacctggatgagacaggtggtcagttttgacaaactcaagcttaccaacaatgagttggatgatcaaggacatatcattctgcactctatgcacaaataccagcctcgagttcatgtgattcgcaaagacttcagcagtgacctttcacccactaagcctgttcctgttggggatggggtgaaaacgttcaactttcctgagactgtgttcaccacagttacggcctatcagaatcagcagattaccagattaaaaattgaccgaaacccttttgctaaaggattcagagattctgggagaaacagaactggacttgaagccatcatggagacatatgcattctggagacctcctgtgcgcacactcaccttcgaagacttcaccaccatgcagaagcagcaaggaggcagcacaggcacttccccaaccacctccagcactgggacaccatccccttcggcttcttctcatcttttatctccatcctgttctcctccaacttttcatctggcccccaacactttcaatgtgggctgccgagaaagccagctgtgtaatctaaacctctctgattatccaccatgtgcccgaagcaacatggctgccttgcagagctacccagggctgagtgacagtggctacaacaggcttcagagtggcaccacttcagccactcagccctctgaaaccttcatgcctcagaggactccatccctgatctcaggaataccaactcctccctcgttgcctggcaacagcaagatggaagcctacggtggccagctggggtcctttcccacttcccagtttcagtatgtcatgcaggcaggcaatgctgcctccagctcctcatcaccacacatgttcgggggcagccacatgcagcagagctcctacaatgccttctcccttcacaacccttacaacctgtatggatacaatttccccacttcccctaggctagctgcaagcccggaaaaactgagcgcctctcaaagcactttactctgttcttctccttccaacggggcctttggagagaggcagtacctgccgtcagggatggagcacagcatgcacatgattagcccttcacccaataaccaacaggcaaccaacacttgtgatggccggcagtatggggcagttccaggctcctcctcccagatgtccgtgcacatggtttaaaggccagtccaaacaccacggagcatttggcaatcaaggccccagagtctccgtggtcagatcctcctctttgggagtccagtgtctttgaaaaacaggaaccgtgttttttttttttttttttttctggccgaagacatatacccaagaacaagagatacctttaagccagtgaaggatacttgcgatagaatcatccgcaactcagtggccattcttctgccttcccagaccttagttttataaagcattgtctgttccagagtggcctttgaagagactgaataatcacttcgtcataatgttaagggagatgctagtgtgtggcagccatgaaaagttacacatacacacccacatacagacagacctacctatacatacgtgcacacacacatacatattcatacacaattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggacttggcttccggaaaaagattgcttttgaactttggctctcttcacttgtatgctatcattgatattcccagtggtgcccgtggaaagagggagaaagagaagctgaacaggagaaagacaaacagaaagaatagagaacaggaacgaggtggagagcaagactgacagagaaagtgtgagcaatgatgagaattttaattcaccaaggagacgtgtttttggtttgtccccccaaaccccgcccgccccactacaggttatggaaagaatcatggcattactgaggagtaaacctctctggcacactgagcatggtcagggcattggtcagagggacagagcaaggaatgcatcctgagcccacagctttgaccactgtgatccagaagagaggtgcactacgtgggaagtgctgattccacagcatgcagcctggtaggggaaggaaaataaaagggtgtgaagaaggaatagttttataatctcggaagatgataccaagagcagaggcaacaaatagaggcctggcctccaggtgccggatccagacacctgacctagaatgcctgcccgctatccctgtggcaggaaatatcccctcatgtcccagggaattgcagatgggtcttctatacccttctacctgcccttagatctccatttttatcaaatagtacattgcattttgaagttttgggttttgtccttcatctttccctttcccttcaaatcttttaatggtaagaaagcaagtgaagcttggtgcaagctaaaatttttaaatggtgtggaaatgcaaataataccaagtaaaataatacagatattattaaagtttctggttttgaggtgttgtagataaatgtatttatgtgcctagtggggaatccaatattatgaatatgaaaaagggggcaataaaagggtatgtaaaatatgtatgaagaaaaggtgtacaaaaatttgcccttatgcacggaactctgtttctaagtgccaagcacagaaagccgctaaataaaatctttgcaattgtt

SEQ ID NO: 189703 - DNA, 3504 bp, Homo sapiens
  Payload ID: 17457
  Gene Symbol: TBX15
  Gene Name: T-box 15
  Uniprot ID: Q96SF7
  ENST ID: ENST00000369429
  CDS Start-End: 11-1819
ggcggctaaaatgagtgaaaggagaagatctgcagtcgccctgagctcgcgagcacatgccttctccgttgaagccttgatcggctcaaataaaaaacggaaactgcgagactgggaggagaaggggctggacctgtctatggaggcgctgagccccgcgggcccactcggagacacggaggacgcggcggcacacggcctggagcctcacccggattctgagcagagcactggttcagattctgaggtcctcactgagcggacttcctgctccttcagtactcacactgacctggcctctggtgctgcaggccctgtgcctgctgccatgtcttccatggaggagattcaggtggagctgcaatgtgctgacctctggaagcggttccatgatattggaactgaaatgatcatcaccaaagcaggcaggaggatgtttcctgccatgagagtgaaaatcactggcctagatccacatcagcagtactacatagcaatggacattgtgcctgtggacaataaaagatacagatatgtgtatcatagctccaagtggatggtggctggcaatgctgattcccctgtgcccccaagagtttatatacaccctgattctctagcttctggagacacctggatgagacaggtggtcagttttgacaaactcaagcttaccaacaatgagttggatgatcaaggacatatcattctgcactctatgcacaaataccagcctcgagttcatgtgattcgcaaagacttcagcagtgacctttcacccactaagcctgttcctgttggggatggggtgaaaacgttcaactttcctgagactgtgttcaccacagttacggcctatcagaatcagcagattaccagattaaaaattgaccgaaacccttttgctaaaggattcagagattctgggagaaacagaactggacttgaagccatcatggagacatatgcattctggagacctcctgtgcgcacactcaccttcgaagacttcaccaccatgcagaagcagcaaggaggcagcacaggcacttccccaaccacctccagcactgggacaccatccccttcggcttcttctcatcttttatctccatcctgttctcctccaacttttcatctggcccccaacactttcaatgtgggctgccgagaaagccagctgtgtaatctaaacctctctgattatccaccatgtgcccgaagcaacatggctgccttgcagagctacccagggctgagtgacagtggctacaacaggcttcagagtggcaccacttcagccactcagccctctgaaaccttcatgcctcagaggactccatccctgatctcaggaataccaactcctccctcgttgcctggcaacagcaagatggaagcctacggtggccagctggggtcctttcccacttcccagtttcagtatgtcatgcaggcaggcaatgctgcctccagctcctcatcaccacacatgttcgggggcagccacatgcagcagagctcctacaatgccttctcccttcacaacccttacaacctgtatggatacaatttccccacttcccctaggctagctgcaagcccggaaaaactgagcgcctctcaaagcactttactctgttcttctccttccaacggggcctttggagagaggcagtacctgccgtcagggatggagcacagcatgcacatgattagcccttcacccaataaccaacaggcaaccaacacttgtgatggccggcagtatggggcagttccaggctcctcctcccagatgtccgtgcacatggtttaaaggccagtccaaacaccacggagcatttggcaatcaaggccccagagtctccgtggtcagatcctcctctttgggagtccagtgtctttgaaaaacaggaaccgtgttttttttttttttttttttctggccgaagacatatacccaagaacaagagatacctttaagccagtgaaggatacttgcgatagaatcatccgcaactcagtggccattcttctgccttcccagaccttagttttataaagcattgtctgttccagagtggcctttgaagagactgaataatcacttcgtcataatgttaagggagatgctagtgtgtggcagccatgaaaagttacacatacacacccacatacagacagacctacctatacatacgtgcacacacacatacatattcatacacaattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggacttggcttccggaaaaagattgcttttgaactttggctctcttcacttgtatgctatcattgatattcccagtggtgcccgtggaaagagggagaaagagaagctgaacaggagaaagacaaacagaaagaatagagaacaggaacgaggtggagagcaagactgacagagaaagtgtgagcaatgatgagaattttaattcaccaaggagacgtgtttttggtttgtccccccaaaccccgcccgccccactacaggttatggaaagaatcatggcattactgaggagtaaacctctctggcacactgagcatggtcagggcattggtcagagggacagagcaaggaatgcatcctgagcccacagctttgaccactgtgatccagaagagaggtgcactacgtgggaagtgctgattccacagcatgcagcctggtaggggaaggaaaataaaagggtgtgaagaaggaatagttttataatctcggaagatgataccaagagcagaggcaacaaatagaggcctggcctccaggtgccggatccagacacctgacctagaatgcctgcccgctatccctgtggcaggaaatatcccctcatgtcccagggaattgcagatgggtcttctatacccttctacctgcccttagatctccatttttatcaaatagtacattgcattttgaagttttgggttttgtccttcatctttccctttcccttcaaatcttttaatggtaagaaagcaagtgaagcttggtgcaagctaaaatttttaaatggtgtggaaatgcaaataataccaagtaaaataatacagatattattaaagtttctggttttgaggtgttgtagataaatgtatttatgtgcctagtggggaatccaatattatgaatatgaaaaagggggcaataaaagggtatgtaaaatatgtatgaagaaaaggtgtacaaaaatttgcccttatgcacggaactctgtttctaagtgccaagcacagaaagccgctaaataaaatctttgcaattgt

SEQ ID NO: 189704 - DNA, 2678 bp, Homo sapiens
  Payload ID: 17457
  Gene Symbol: TBX15
  Gene Name: T-box 15
  ENST ID: ENST00000449873
  CDS Start-End: 1-993
gggagaaacagaactggacttgaagccatcatggagacatatgcattctggagacctcctgtgcgcacactcaccttcgaagacttcaccaccatgcagaagcagcaagcctcaaagaagacttctcaaggatacacagtgaatcagcactcctcagagacagatgccattgaattatacgagagaagagtctggctcatggaacgaagaggcagcacaggcacttccccaaccacctccagcactgggacaccatccccttcggcttcttctcatcttttatctccatcctgttctcctccaacttttcatctggcccccaacactttcaatgtgggctgccgagaaagccagctgtgtaatctaaacctctctgattatccaccatgtgcccgaagcaacatggctgccttgcagagctacccagggctgagtgacagtggctacaacaggcttcagagtggcaccacttcagccactcagccctctgaaaccttcatgcctcagaggactccatccctgatctcaggaataccaactcctccctcgttgcctggcaacagcaagatggaagcctacggtggccagctggggtcctttcccacttcccagtttcagtatgtcatgcaggcaggcaatgctgcctccagctcctcatcaccacacatgttcgggggcagccacatgcagcagagctcctacaatgccttctcccttcacaacccttacaacctgtatggatacaatttccccacttcccctaggctagctgcaagcccggaaaaactgagcgcctctcaaagcactttactctgttcttctccttccaacggggcctttggagagaggcagtacctgccgtcagggatggagcacagcatgcacatgattagcccttcacccaataaccaacaggcaaccaacacttgtgatggccggcagtatggggcagttccaggctcctcctcccagatgtccgtgcacatggtttaaaggccagtccaaacaccacggagcatttggcaatcaaggccccagagtctccgtggtcagatcctcctctttgggagtccagtgtctttgaaaaacaggaaccgtgttttttttttttttttttttctggccgaagacatatacccaagaacaagagatacctttaagccagtgaaggatacttgcgatagaatcatccgcaactcagtggccattcttctgccttcccagaccttagttttataaagcattgtctgttccagagtggcctttgaagagactgaataatcacttcgtcataatgttaagggagatgctagtgtgtggcagccatgaaaagttacacatacacacccacatacagacagacctacctatacatacgtgcacacacacatacatattcatacacaattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggacttggcttccggaaaaagattgcttttgaactttggctctcttcacttgtatgctatcattgatattcccagtggtgcccgtggaaagagggagaaagagaagctgaacaggagaaagacaaacagaaagaatagagaacaggaacgaggtggagagcaagactgacagagaaagtgtgagcaatgatgagaattttaattcaccaaggagacgtgtttttggtttgtccccccaaaccccgcccgccccactacaggttatggaaagaatcatggcattactgaggagtaaacctctctggcacactgagcatggtcagggcattggtcagagggacagagcaaggaatgcatcctgagcccacagctttgaccactgtgatccagaagagaggtgcactacgtgggaagtgctgattccacagcatgcagcctggtaggggaaggaaaataaaagggtgtgaagaaggaatagttttataatctcggaagatgataccaagagcagaggcaacaaatagaggcctggcctccaggtgccggatccagacacctgacctagaatgcctgcccgctatccctgtggcaggaaatatcccctcatgtcccagggaattgcagatgggtcttctatacccttctacctgcccttagatctccatttttatcaaatagtacattgcattttgaagttttgggttttgtccttcatctttccctttcccttcaaatcttttaatggtaagaaagcaagtgaagcttggtgcaagctaaaatttttaaatggtgtggaaatgcaaataataccaagtaaaataatacagatattattaaagtttctggttttgaggtgttgtagataaatgtatttatgtgcctagtggggaatccaatattatgaatatgaaaaagggggcaataaaagggtatgtaaaatatgtatgaagaaaaggtgtacaaaaatttgcccttatgcacggaactctgtttctaagtgccaagcacagaaagccgctaaataaaatctttgcaattgt

SEQ ID NO: 189705 - DNA, 6245 bp, Homo sapiens
  Payload ID: 17458
  Gene Symbol: TBX18
  Gene Name: T-box 18
  Uniprot ID: O95935
  ENST ID: ENST00000369663
  CDS Start-End: 339-2162
ttttttacccatgttagtcctctctggcgcatcagttgaggcagacctcggagcagcaggaggaggtggaaggggtgggagcaaaggagtgcatcagtgagagagcgcgcgagagagacccaggaaaggagacttggccggcgcgtcgccggttcctggatcccaacacaagcgagaaagcggaaacgccaaatctgttttttgcccgcggtggggaagggggcagatctcgggaggccccgagagccttttagtttttggtgggggaagagcgagagcgcgcgtgtgcccgcgtgagtgtatatgagagaggggcgggcgggcgcggggcgggggggatggccgagaagcgaaggggctcgccgtgcagcatgctaagcctcaaggcgcacgctttctcggtggaggcgctgatcggcgccgagaagcagcaacagcttcagaagaagcggcgaaaactgggcgccgaagaggcggcgggggccgtggacgacggaggctgcagccgcggcggcggcgcgggcgaaaagggttcttctgagggagacgaaggcgctgcgctcccgccgccggctggggcgacgtctgggccggctcggagtggcgcagacctggagcgcggagccgcgggcggctgtgaggacggcttccagcagggagcttcccctctggcgtcaccgggaggctcccccaaggggtctccggcgcgctccctggcccggcccgggacccctctgccctcgccgcaggccccgcgggtggatctgcagggagccgagctctggaagcgctttcatgagataggcactgagatgatcatcaccaaggccggcaggcgcatgtttccagcaatgagagtgaagatctctggattagatcctcaccagcaatattacattgccatggatattgtaccagtggacaacaaaagatacaggtatgtttaccacagttcgaaatggatggtggcaggtaatgctgactcgcctgtgccaccccgtgtgtacattcatccagactcgcctgcctcgggggagacttggatgagacaagttatcagcttcgacaagctgaagctcaccaacaatgaactggatgaccaaggccatattattcttcattctatgcacaaataccaaccgcgagtgcacgtcatccgtaaagactgtggagacgatctttctcccatcaagcctgttccatccggggagggagtaaaggcattctcctttccagaaactgtcttcacaaccgtcactgcctatcagaatcagcagattactcgcctgaagatagataggaatccatttgctaaaggcttccgagactccgggcgcaacagaatgggtttggaagccttggtggaatcatatgcattctggcgaccatcactacggactctgacctttgaagatatccctggaattcccaagcaaggcaatgcaagttcctccaccttgctccaaggtactgggaatggcgttcctgccactcaccctcaccttttgtctggctcctcttgctcctctcctgccttccatctggggcccaacaccagccagctgtgtagtctggcccctgctgactattctgcctgtgcccgctcaggcctcaccctcaaccgatacagcacatctttggcagagacctacaacaggctcaccaaccaggctggtgagacctttgccccgcccaggactccctcctatgtgggcgtgagcagcagcacctccgtgaacatgtccatgggtggcactgatggggacaccttcagctgcccacagaccagcttatccatgcagatttcgggaatgtccccccagctccagtatatcatgccatcaccctccagcaatgccttcgccactaaccagacccatcagggttcctataatacttttagattacacagcccctgtgcactatatggatataacttctccacatcccccaaactggctgccagtcctgagaaaattgtttcttcccaaggaagtttcttggggtcctcaccgagtgggaccatgacggatcggcagatgttgccccctgtggaaggagtgcacctgcttagcagtgggggtcagcagagtttctttgactctaggaccctaggaagcttaactctgtcatcatctcaagtatctgcacatatggtctgatgaagcctttaagttaaatgacatttggatctgtctaacatattttctttttcttttttaaaagctatgtggaaagaaactctctgtggtttataaaatgtacatataatagaaaatgaaggctcactgggttttttgactttatcatggtgagattgtaattatctatggtatatatgtatgctgtatatacatagcacatggagtatcacggcccctattgttcccctgtttcatccagttgcacggagtattggcatgcgtgtagtatgtttaagcaaagttctcagactcttttaaaaacaagatggtaaacttaaaacttggcaattatactatccagaagaacacttataacttaatttatcagaaaaatgctctaaacggtttcatacttgatgtattgataaccagcagtaaccagcatgtagagtcttgtgatttctgttattcttggacacagtgtgagaatctaaaatacaaaagccagttgaagtcttagtgttagtcctgaggtatttgtaatcatgaaggatcagctttttcattcctgcttattatttaccacacatactatatgaccttgggtctataaaaaaatcataacccataataattgttattttcttaaggaaggtaaaggagaggcttgtgatttttttttttacactttccattgggcacataagaggttcttattcatctgtagagaacaaatttccagtattttcgattttttgcttattttatatatcaaatagaccattaaagaatgttctataaacatttttaaattccaattttcaccaggggaggaatatgtgatatgagtggaatggcaaaaggaaaataaatccacctcaaattcattgattccaatgagaaatgtctatcttttaaatcaagagtaatactattgttaactataccttatgtttttgtatagtttgtttttaaatttagaatattttttccatcttgctctgagcttcctgaccgatagtatataagtaaaaaaaatgcatttatgctacttatttatatcttgtaattcctacacattgaacccttttccccttcttaaccttgtccgtctgcctgagtctttcccaaaacagatagttcctaggcctgtatggtgttaaataacacggtgaggaatttcagtaggttatctccagcaatctgtcttttgggagctatagtgcaaaggccaaagcccattactataaagaccctcttggaggactaagaaggaagatactaattatgataaaggaactataaaacttttaacctcaacagaatttgtaatgtcagaactggagaaattaaaatcagtattaaattttttaattcctaaaataatatatgcatggttgaagagttaaaaacaagtaactttgagagcacagtatgagataaataaaaaaggctaagaatacatgatgaggcacattccccttctgaggagaaagcgaaataacatgtctgtgcattgacccattcattacatttcatgtatcttaagcaaaagagcatgattttctctcattgctaaaaagagttgctttaactcatccctggatttggtggggaaagggtacaactcctgatttgctgtttcactttgaaacaacacaatttgttagatacttagggagatatactgttgaatttgcacaggatgtgactctgtttatacatattaacaaatttccttttggattccttagcagttcatcaaattagtattaaatttttaaatttaaaactagcatgaagggacatgaaatatttgcagtaggtggatctatgtaagatgtttgggtatggcattaatagcttgacaaagatttggggaaaggtgttaagaatgagtccatctcagccaatagtgcttggtgtataattcaagaacagagagttttccatcttgaaaaaacatggaaagtaatgctctatacccatatgtattaataagagcattttccttcttgccgttgatcatttcagatgataccacaatatgagtataattttttattaatcttttttctggtaaaattttagcaatattgtacaaatgctttttttaggttttactgtaaatattaatcaccacgtcacttcagagactagccttttattgctgaattaaatgacatgcatacattgataattatatatctgtattttattaaaaagtacttaaaattatattaaaatatgttattaaacccttttatgattttggagggtaatcattttaatgtctaaaaatattgatccaagaataagcacacacatgcacaccccaaacgcaaattctgtacctctcaaatacatggcagaaagaaatgggcctgctgttcatgtttcatgtgttaaatgtaatttcttggtgtgttgaccatgtcattgaaggtgaaggccctgacaaatgttgaacacatgaaaatttgaatgtgagaggaaagggatggggtggtatgttttgttttgggtccaggggagaaaggcaaggttacaagaatgagtggcttgcaccactgactagtgatgacagattacttctatgccccttgactagtaaacattccaagggacatcgcgatggggtgaggttgctgctatcaagaccagtcacattttgaaaattaacacttgcttccttacaagctgccttccagaggtcaacagcttttcacaagtgaggcacccagttgctgacccttgatttctggaatgtaaggggtcaggaatccttggtggcccccagagaaggttggggcacagtgtaacctatataaggaaggatcatactcactctttacatcaattagcaaaattttgaggaaaaagaatctcacttttaaaatgtaaatagctcttcattacccctccagacttaatcctaccagtaactcacaccttagtgtgaaattaataaacagcagctttggagatagctggaggtttgacttagaggaaaaagtaatttttgtagcaggacaattctgggaagatttgtatgggaaggagaaggtgcaagaagagagatccctaactaaactctgcagtgtcccatgaagtcctggtgcagagcattaaaaataatcatttcataaacttctttcaggaaccttggtagaggtggtggatgctacctaccctgatgctgtctctaattagagaggtttgtaaagattcctttgttgcaaagtgtaacacagtgttatttcctcatgagaaatttattggctcatctacatgaagttttttctaagctttcccttaagaactaattgtattaaattattaccatgttgtgttttaatctcattgttcatcctttctaaaaagaaatgctcagataagttgagagtaaggttaaatatatgagcagttaagtactcatacatgattacagcattctaagagttcaaaccttaaaaattatcagtgctagaaatcgacaaatatattcaagtatacaaacattcaacagatatataaacttagtatccctctacatgctgatatattttcaaataatgtgctttcttttcattgaactgtggtatgatgagaataacatgtcctcgggaattagagaacttagtttgagactatggatttctcaatcatgattttgggtaaaaaaattagctgctttatgtctcagttttgctatgtgtgaaaggaatggctgggatgataattgttagtattccttttagtttccaattcatatggtcctattatataaatatttagcttaatattgggaaactagttttataaaactattatatcttttggaatatattctgtttatttttggatatatatatatatatactgtatctgtggctttacaaagaatataacactatcagtattattttcaacttgttgaattatgtgaaatttatcctttaaatggaactgtgctttagttttacaggataaattttagtattttaatatcagaaggaagctatacttagtaacgtatttgctactttatagtgaatagtaaaagacattaataaaatttctttttcatgatgctcttaa

SEQ ID NO: 189706 - DNA, 742 bp, Homo sapiens
  Payload ID: 17458
  Gene Symbol: TBX18
  Gene Name: T-box 18
  ENST ID: ENST00000606325
  CDS Start-End: 213-742
ggcatatttggaaacttggtttcccgaagggcggctgtgaggacggcttccagcagggagcttcccctctggcgtcaccgggaggctcccccaaggggtctccggcgcgctccctggcccggcccgggacccctctgccctcgccgcaggccccgcgggtggatctgcagggagccgagctctggaagcgctttcatgagataggcactgagatgatcatcaccaaggccggcaggcgcatgtttccagcaatgagagtgaagatctctggattagatcctcaccagcaatattacattgccatggatattgtaccagtggacaacaaaagatacaggtatgtttaccacagttcgaaatggatggtggcaggtaatgctgactcgcctgtgccaccccgtgtgtacattcatccagactcgcctgcctcgggggagacttggatgagacaagttatcagcttcgacaagctgaagctcaccaacaatgaactggatgaccaaggccatattattcttcattctatgcacaaataccaaccgcgagtgcacgtcatccgtaaagactgtggagacgatctttctcccatcaagcctgttccatccggggagggagtaaaggcattctcctttccagaaactgtcttcacaaccgtcactgcctatcagaatcagcagattactcgcctgaagatagataggaatccatttgctaaaggcttccgagactccgggcgcaacag

SEQ ID NO: 189707 - DNA, 1230 bp, Homo sapiens
  Payload ID: 17458
  Gene Symbol: TBX18
  Gene Name: T-box 18
  ENST ID: ENST00000606784
  CDS Start-End: 213-911
ggcatatttggaaacttggtttcccgaagggcggctgtgaggacggcttccagcagggagcttcccctctggcgtcaccgggaggctcccccaaggggtctccggcgcgctccctggcccggcccgggacccctctgccctcgccgcaggccccgcgggtggatctgcagggagccgagctctggaagcgctttcatgagataggcactgagatgatcatcaccaaggccggcaggcgcatgtttccagcaatgagagtgaagatctctggattagatcctcaccagcaatattacattgccatggatattgtaccagtggacaacaaaagatacaggtatgtttaccacagttcgaaatggatggtggcaggtaatgctgactcgcctgtgccaccccgtgtgtacattcatccagactcgcctgcctcgggggagacttggatgagacaagttatcagcttcgacaagctgaagctcaccaacaatgaactggatgaccaaggccatattattcttcattctatgcacaaataccaaccgcgagtgcacgtcatccgtaaagactgtggagacgatctttctcccatcaagcctgttccatccggggagggagtaaaggcattctcctttccagaaactgtcttcacaaccgtcactgcctatcagaatcagcagattactcgcctgaagatagataggaatccatttgctaaaggcttccgagactccgggcgcaacagaatgggtttggaagccttggtggaatcatatgcattctggcgaccatcactacggactctgacctttgaagatatccctggaattcccaagcaagaatacagggacttgaagacagactacatttttcctgagcgagacaatttggtctcaagggaaaccaaactgtagcacagaatgtgagagagagcaacaataggatggaatgcataaaatccttccccagagcaagcttctcccacttcttgaaaggctttatttttatatagcctctggaagccagacaaagtatcacttagaaagcgagcctcacagggcggctctggagagatctgaaggctgcgttcataagttcagaaagaacaaagtttatgctttaggccgctagaccgtaagctctttgagttcagtttttatcttcattgtatttcaagaactgtgcaagtatctggtacctggaatatgctcaataaatgtttgaataaagatt

SEQ ID NO: 189708 - DNA, 717 bp, Homo sapiens
  Payload ID: 17458
  Gene Symbol: TBX18
  Gene Name: T-box 18
  ENST ID: ENST00000606621
  CDS Start-End: 621-717
gcttttcacacttttctctgctgggctggaagcgcagggcgccgggagtttggcgaaagcggggtctgaagagccttctagaagatgcctccggcccggcccaaaagaaggcccaaagcgaggcgccgcagacgcttatggcttaaggaggcccaggctcttgggaccagagtccgggcgcttttgctgcttgcgcttcgaggcgcaggttgcgtcggagtttgcactggggactctggacccgggagctcctctgactccgtcgggcaagcgtcccagaccccggcggcggcgtgaagccttttctgctggggccttggccctgcggaggcccagcgggtggggtggacgctgcccgcgcgcctctcccgggcttgggacttggggaccaagcaggccacactggagctctgaatgcgccccttcgacaggcagaatgcggctgtgaggacggcttccagcagggagcttcccctctggcgtcaccgggaggctcccccaaggggtctccggcgcgctccctggcccggcccgggacccctctgccctcgccgcaggccccgcgggtggatctgcagggagccgagctctggaagcgctttcatgagataggcactgagatgatcatcaccaaggccggcaggcgcatgtttccagcaatgagagtgaagatctctggattagatcctcaccagcaatattacattgccatggata

SEQ ID NO: 189709 - DNA, 2822 bp, Homo sapiens
  Payload ID: 17459
  Gene Symbol: TBX19
  Gene Name: T-box 19
  Uniprot ID: O60806
  ENST ID: ENST00000367821
  CDS Start-End: 52-1398
tagaagcaggcaagttgggtaacggctctcggcaaagttcgagaagtgcctatggccatgagtgagctgggcactcggaagcccagcgatggcactgtttctcatctgctcaatgtggtggagagtgagcttcaggcagggagggaaaaaggcgaccctacggagaagcaacttcagatcatcctggaggatgcacctctctggcagagattcaaggaagtcactaatgagatgattgtgaccaagaatggcagacggatgtttccagtcctaaagattagtgtcacagggttggaccccaatgccatgtactccctcctgctggactttgtccctacggacagtcaccgctggaagtacgtcaacggggaatgggtgcccgctggcaagccagaggtctccagccacagctgcgtctacattcacccggactcccccaactttggggcccactggatgaaagctcccatctccttcagcaaagtgaagctgaccaacaagctcaatggaggcgggcagataatgttgaattctctgcataaatatgaaccccaggttcacatagtgcgtgttggaagtgcccatcgaatggtaacaaactgctccttccctgaaacccagttcatagccgtgactgcctatcagaatgaggagataacggctctcaaaatcaagtacaatccttttgccaaagccttcttggatgccaaggaaagaaatcacctaagagacgtaccggaggctatctctgagagccagcatgtgacctattctcacttgggaggctggatcttttccaatccagatggagtgtgcacagcaggaaactccaattaccagtatgccgctcctctgcctctgcctgctccccacacccaccatggctgtgagcactattcgggtctccgaggacaccggcaggctccctacccttctgcgtacatgcacagaaaccattctccctcagtgaatttgatagaaagctcaagcaataatctgcaagttttctcgggacctgacagctggacttccttatcctccacaccccatgccagcatcctgtctgtaccccacaccaacggaccaatcaatccagggcccagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcacttccttttctgtggagaaggtgcaaagctgttaaatgagctcagagtttacctagctaaggccactgcttcctgctttgtgaagcctggaaagtatgtgtggccacagggctcaggttcacacttctgctttgagaccaggatggggtgtaagccatagagtaaggttaacaaaaagaataaagctaatcatgtattacaaacagcagtgtgcccagacttgtggaaatgaagtcatgtcactcctctgctcagaaaccttcaatggttcaccattaccagtggaatgaagtcaattctcctcactataactgggtgtggtagtttaagcctataatctcagcccttttggaggccaaggtaagaggatcgcttgaggtcaggagttcgagaccagcttgtgcaacaaagtgagagcctgtctctacaaaaaatagtcatgcacacaaaattagctgggcatggtggcctgtgcctatagtcccaactacttagaggaggatcgcttgatctcaggaggttgaggctgcagtgaattatgattgtggcattgcactccagcctgggtggtagatcaaggctttgtttcatttgaaaaaaaagaaagaaagaaagaaagaaagaaatcctactacgagcgatcacaccatctggcctgaaaccacttccccagcttaggtccctctgttatcctgttggcctcctatgtattggtcaaggcaggcatctctgttctctgaacattcattgcactttcccacctctataccttgcctgtgccttagtgtcctcttttttccagttcacctgtgcgaatccgacccacctcccagagcctggctgaaacgtcactccctgcatccaacatctgatctgctgagatatgtctgatctatctctgctcgctgttctcccgttgtttttgcctctgccatagagctcacctcattttgccttgtatttttgttacctgtgagtgtgtctctccctattagactgtaagcctctcgagggtgaggcctagccttcttgtctttgtaacccacagcagctggtactgtgccttgcctattgtaggtgcccaataaacatttgctgaactgaa

SEQ ID NO: 189710 - DNA, 1757 bp, Homo sapiens
  Payload ID: 17459
  Gene Symbol: TBX19
  Gene Name: T-box 19
  ENST ID: ENST00000441464
  CDS Start-End: 1-844
aaaagagagggaattaaactggttttacagaagacaaagggttctgtttgcccatgtgtatcctacttttactaacacttcttgtctttgtaaatgcaagataacggctctcaaaatcaagtacaatccttttgccaaagccttcttggatgccaaggaaagaaatcacctaagagacgtaccggaggctatctctgagagccagcatgtgacctattctcacttgggaggctggatcttttccaatccagatggagtgtgcacagcaggaaactccaattaccagtatgccgctcctctgcctctgcctgctccccacacccaccatggctgtgagcactattcgggtctccgaggacaccggcaggctccctacccttctgcgtacatgcacagaaaccattctccctcagtgaatttgatagaaagctcaagcaataatctgcaagttttctcgggacctgacagctggacttccttatcctccacaccccatgccagcatcctgtctgtaccccacaccaacggaccaatcaatccagggcccagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcacttccttttctgtggagaaggtgcaaagctgttaaatgagctcagagtttacctagctaaggccactgcttcctgctttgtgaagcctggaaagtatgtgtggccacagggctcaggttcacacttctgctttgagaccaggatggggtgtaagccatagagtaaggttaacaaaaagaataaagctaatcatgtattacaaacagcagtgtgcccagacttgtggaaatgaagtcatgtcactcctctgctcagaaaccttcaatggttcaccattaccagtggaatgaagtcaattctcctcactataactgggtgtggtagtttaagcctataatctcagcccttttggaggccaaggtaagaggatcgcttgaggtcaggagttcgagaccagcttgtgcaacaaagtgagagcctgtctctacaaaaaatagtcatgcacacaaaattagctgggcatggtggcctgtgcctatagtcccaactacttagaggaggatcgcttgatctcaggaggttgaggctgcagtgaattatgattgtggcattgcactccagcctgggtggtagatcaaggctttgtttcatttg

SEQ ID NO: 189711 - DNA, 2377 bp, Homo sapiens
  Payload ID: 17459
  Gene Symbol: TBX19
  Gene Name: T-box 19
  ENST ID: ENST00000431969
  CDS Start-End: 1-955
acggatgtttccagtcctaaagattagtgtcacagggttggaccccaatgccatgtactccctcctgctggactttgtccctacggacagtcaccgctggaagtacgtcaacggggaatgggtgcccgctggcaagccagaggtctccagccacagctgcgtctacattcacccggactcccccaactttggggcccactggatgaaagctcccatctccttcagcaaagtgaagctgaccaacaagctcaatggaggcgggcagataatgttgaattctctgcataaatatgaaccccaggttcacatagtgcgtgttggaagtgcccatcgaatggtaacaaactgctccttccctgaaacccagttcatagccgtgactgcctatcagaatgaggagataacggctctcaaaatcaagtacaatccttttgccaaagccttcttggatgccaaggaaagaaatcacctaagagacgtaccggaggctatctctgagagccagcatgtgacctattctcacttgaatttgatagaaagctcaagcaataatctgcaagttttctcgggacctgacagctggacttccttatcctccacaccccatgccagcatcctgtctgtaccccacaccaacggaccaatcaatccagggcccagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcacttccttttctgtggagaaggtgcaaagctgttaaatgagctcagagtttacctagctaaggccactgcttcctgctttgtgaagcctggaaagtatgtgtggccacagggctcaggttcacacttctgctttgagaccaggatggggtgtaagccatagagtaaggttaacaaaaagaataaagctaatcatgtattacaaacagcagtgtgcccagacttgtggaaatgaagtcatgtcactcctctgctcagaaaccttcaatggttcaccattaccagtggaatgaagtcaattctcctcactataactgggtgtggtagtttaagcctataatctcagcccttttggaggccaaggtaagaggatcgcttgaggtcaggagttcgagaccagcttgtgcaacaaagtgagagcctgtctctacaaaaaatagtcatgcacacaaaattagctgggcatggtggcctgtgcctatagtcccaactacttagaggaggatcgcttgatctcaggaggttgaggctgcagtgaattatgattgtggcattgcactccagcctgggtggtagatcaaggctttgtttcatttgaaaaaaaagaaagaaagaaagaaagaaagaaatcctactacgagcgatcacaccatctggcctgaaaccacttccccagcttaggtccctctgttatcctgttggcctcctatgtattggtcaaggcaggcatctctgttctctgaacattcattgcactttcccacctctataccttgcctgtgccttagtgtcctcttttttccagttcacctgtgcgaatccgacccacctcccagagcctggctgaaacgtcactccctgcatccaacatctgatctgctgagatatgtctgatctatctctgctcgctgttctcccgttgtttttgcctctgccatagagctcacctcattttgccttgtatttttgttacctgtgagtgtgtctctccctattagactgtaagcctctcgagggtgaggcctagccttcttgtctttgtaacccacagcagctggtactgtgccttgcctattgtaggtgcccaataaacatttgctgaactg

SEQ ID NO: 189712 - DNA, 3339 bp, Homo sapiens
  Payload ID: 17460
  Gene Symbol: TBX2
  Gene Name: T-box 2
  Uniprot ID: Q13207
  ENST ID: ENST00000240328
  CDS Start-End: 282-2420
cagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggcggatgttcccccccttcaaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaagatcacacagctgaagatcgacaacaacccgtttgccaagggcttccgggacaccgggaacggccggcgggagaaaaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgtagtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcccggcccgcgggctccacctcaggttttcacttttcgctccggagcgagaacgaaa

SEQ ID NO: 189713 - DNA, 3344 bp, Homo sapiens
  Payload ID: 17460
  Gene Symbol: TBX2
  Gene Name: T-box 2
  ENST ID: ENST00000419047
  CDS Start-End: 268-708
agatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaagatcacacagctgaagatcgacaacaacccgtttgccaagggcttccgggacaccgggaacggccggcgggagaaaaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgtagtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcccggcccgcgggctccacctcaggttttcacttttcgctccggagcgagaacgaaacgacaaaaacgcaagaaaacaataaaacgctagaaagcgaa

SEQ ID NO: 189714 - DNA, 1871 bp, Homo sapiens
  Payload ID: 17461
  Gene Symbol: TBX20
  Gene Name: T-box 20
  Uniprot ID: Q9UMR3
  ENST ID: ENST00000408931
  CDS Start-End: 528-1871
ggatcgccgccgccagcaaattaaggcgcagggcagcgagcgccagggctcactgtccgtagttccgcgccgcgctccccacgccagcgtcctagcagccgcgctcggctggtggccacctcagcctgggacatcccggctgtccccagccccagagggaggaaggacgcggaggggatgctccaggaccccaggactttgtgcagttgatgctcgtttccgccttcgggctgtgcagactgtcgtcctgccgagcgccccggggcgtgcgcacccgccgtagtgctcggtgggccctctcctctccggctgccttcgaagtctctgcggctctggggctttgcggtggggaatagaggccagtgtgcagctctggagtcgttggagctgacacttctggagtccctggccccgctgtgactgctctcggaaactttgagctgtgtttcgggtctttgtctcccttggggaatctggacggcagttcggacgaccccgtccctggccaggaccgcgtgctggggaccatggagttcacggcgtcccccaagccccaactctcctctcgggccaacgccttctccattgccgcgctcatgtcgagcggcggctctaaggagaaggaggcgacggagaacacaatcaaacccctggagcaatttgtggagaagtcgtcctgtgcccagcccctgggtgagctgaccagcctggatgctcatggggagtttggtggaggcagtggcagcagcccgtcctcctcctctctgtgcactgagccactgatccccaccacccccatcatccccagtgaggaaatggccaaaattgcctgcagcctggagaccaaggagctttgggacaaattccatgagctgggcaccgagatgatcatcaccaagtcgggcaggaggatgtttccaaccatccgggtgtccttttcgggggtggatcctgaggccaagtacatagtcctgatggacatcgtccctgtggacaacaagaggtaccgctacgcctaccaccggtcctcctggctggtggctggcaaggccgacccgccgttgccagccaggctctatgtgcatccagattctccttttaccggtgagcaactactcaaacagatggtgtcttttgaaaaggtgaaactcaccaacaatgaactggatcaacatggccatataattttgaactcaatgcataagtaccagccaagggtgcacatcattaagaagaaagaccacacagcctcattgctcaacctgaagtctgaagaatttagaactttcatctttccagaaacagtttttacggcagtcactgcctaccagaatcaactgataacgaagctgaaaatagatagcaatccttttgccaaaggattccgggattcctccaggctcactgacattgagagggaaagtgtggagagcctgattcaaaagcattcctatgcacgctcacccatccgtacctacggaggagaagaagatgtcttgggggatgagagtcagacaaccccaaatcgagggtcagcctttacaacatctgataatttgtctctcagctcctgggtatcatcttcttccagttttcctgggtttcagcacccacagtccctgactgctcttggcaccagcacagcatccatagcaacacccattcctcaccccatccagggttctctgccaccatatagccgactgggaatgcctctgacaccatcggccattgccagctccatgcaagggagtggccccacattcccttcattccacatgccgcgataccatcactattttcagcaggggccctatgctgccattcaaggactacgccattcctctgctgtgatgacgccatttgtatga

SEQ ID NO: 189715 - DNA, 2572 bp, Homo sapiens
  Payload ID: 17462
  Gene Symbol: TBX21
  Gene Name: T-box 21
  Uniprot ID: Q9UL17
  ENST ID: ENST00000177694
  CDS Start-End: 212-1819
cggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggcggatgttcccattcctgtcatttactgtggccgggctggagcccaccagccactacaggatgtttgtggacgtggtcttggtggaccagcaccactggcggtaccagagcggcaagtgggtgcagtgtggaaaggccgagggcagcatgccaggaaaccgcctgtacgtccacccggactcccccaacacaggagcgcactggatgcgccaggaagtttcatttgggaaactaaagctcacaaacaacaagggggcgtccaacaatgtgacccagatgattgtgctccagtccctccataagtaccagccccggctgcatatcgttgaggtgaacgacggagagccagaggcagcctgcaacgcttccaacacgcatatctttactttccaagaaacccagttcattgccgtgactgcctaccagaatgccgagattactcagctgaaaattgataataacccctttgccaaaggattccgggagaactttgagtccatgtacacatctgttgacaccagcatcccctccccgcctggacccaactgtcaattccttgggggagatcactactctcctctcctacccaaccagtatcctgttcccagccgcttctaccccgaccttcctggccaggcgaaggatgtggttccccaggcttactggctgggggccccccgggaccacagctatgaggctgagtttcgagcagtcagcatgaagcctgcattcttgccctctgcccctgggcccaccatgtcctactaccgaggccaggaggtcctggcacctggagctggctggcctgtggcaccccagtaccctcccaagatgggcccggccagctggttccgccctatgcggactctgcccatggaacccggccctggaggctcagagggacggggaccagaggaccagggtccccccttggtgtggactgagattgcccccatccggccggaatccagtgattcaggactgggcgaaggagactctaagaggaggcgcgtgtccccctatccttccagtggtgacagctcctcccctgctggggccccttctccttttgataaggaagctgaaggacagttttataactattttcccaactgagcagatgacatgatgaaaggaacagaaacagtgttattaggttggaggacaccgactaatttgggaaacggatgaaggactgagaaggcccccgctccctctggcccttctctgtttagtagttggttggggaagtggggctcaagaaggattttggggttcaccagatgcttcctggcccacgatgaaacctgagaggggtgtccccttgccccatcctctgccctaactacagtcgtttacctggtgctgcgtcttgcttttggtttccagctggagaaaagaagacaagaaagtcttgggcatgaaggagctttttgcatctagtgggtgggaggggtcaggtgtgggacatgggagcaggagactccactttcttcctttgtacagtaactttcaaccttttcgttggcatgtgtgttaatccctgatccaaaaagaacaaatacacgtatgttataaccatcagcccgccagggtcagggaaaggactcacctgactttggacagctggcctgggctccccctgctcaaacacagtggggatcagagaaaaggggctggaaaggggggaatggcccacatctcaagaagcaagatattgtttgtggtggttgtgtgtgggtgtgtgttttttctttttctttctttttattttttttgaatgggggaggctatttattgtactgagagtggtgtctggatatattccttttgtcttcatcactttctgaaaataaacataaaactgtt

SEQ ID NO: 189716 - DNA, 2249 bp, Homo sapiens
  Payload ID: 17463
  Gene Symbol: TBX22
  Gene Name: T-box 22
  Uniprot ID: Q9Y458
  ENST ID: ENST00000373294
  CDS Start-End: 29-1591
gcaaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttgaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggcggatgttcccctctgttcgggtcaaggtgaaagggttggatccagggaagcagtaccatgtggccatcgatgtggtgccggtggattccaaacgctataggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacagattacgaaactaaaaatagaaagaaatccttttgctaaaggatttagagatactggaagaaacaggggtgtattggatgggcttttagagacctacccatggaggccttctttcactctcgattttaaaacctttggcgcagacacacaaagtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgatactccaccagtgaaaattgatgctaagtgatgggattttcaattatactgaagctagttcaccacgttaactgcattttacacattgacaatgacaaaaagaagatggatgtaattctcatgaaagcagtgaagcaatttcagttttaaaaatgaagatcggctttcatgtaattatctagtagttgtagaagaaaatttaattatttgtttgcctcatgcctttatactttgctgttgaagaaactactaatctcaatttaagatacaaataaggacacaaactttcaagtattatattttatttatctttgtagcctaaagaccatttaatcttgaaggaacacaaagatcaaatgaaaagtaaaacactctaaataaatttgcttttattttc

SEQ ID NO: 189717 - DNA, 2355 bp, Homo sapiens
  Payload ID: 17463
  Gene Symbol: TBX22
  Gene Name: T-box 22
  Uniprot ID: Q9Y458
  ENST ID: ENST00000373296
  CDS Start-End: 135-1697
cttctctgggctcttgagaagagctgctgcaggcatttgcagagtgaatgagctctgactgagacttgacttcagaaccactgggctggcctggcctcttgacacagcaacacactgcttcttgccttccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttgaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggcggatgttcccctctgttcgggtcaaggtgaaagggttggatccagggaagcagtaccatgtggccatcgatgtggtgccggtggattccaaacgctataggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacagattacgaaactaaaaatagaaagaaatccttttgctaaaggatttagagatactggaagaaacaggggtgtattggatgggcttttagagacctacccatggaggccttctttcactctcgattttaaaacctttggcgcagacacacaaagtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgatactccaccagtgaaaattgatgctaagtgatgggattttcaattatactgaagctagttcaccacgttaactgcattttacacattgacaatgacaaaaagaagatggatgtaattctcatgaaagcagtgaagcaatttcagttttaaaaatgaagatcggctttcatgtaattatctagtagttgtagaagaaaatttaattatttgtttgcctcatgcctttatactttgctgttgaagaaactactaatctcaatttaagatacaaataaggacacaaactttcaagtattatattttatttatctttgtagcctaaagaccatttaatcttgaaggaacacaaagatcaaatgaaaagtaaaacactctaaataaatttgcttttattttc

SEQ ID NO: 189718 - DNA, 2355 bp, Homo sapiens; identical to SEQ ID NO: 189717
  Payload ID: 17463
  Gene Symbol: TBX22
  Gene Name: T-box 22
  Uniprot ID: Q9Y458
  ENST ID: ENST00000619509
  CDS Start-End: 135-1697

SEQ ID NO: 189719 - DNA, 1955 bp, Homo sapiens
  Payload ID: 17463
  Gene Symbol: TBX22
  Gene Name: T-box 22
  ENST ID: ENST00000625441
  CDS Start-End: 135-518
cttctctgggctcttgagaagagctgctgcaggcatttgcagagtgaatgagctctgactgagacttgacttcagaaccactgggctggcctggcctcttgacacagcaacacactgcttcttgccttccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttgaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcggatgttcccctctgttcgggtcaaggtgaaagggttggatccagggaagcagtaccatgtggccatcgatgtggtgccggtggattccaaacgctataggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacagattacgaaactaaaaatagaaagaaatccttttgctaaaggatttagagatactggaagaaacaggggtgtattggatgggcttttagagacctacccatggaggccttctttcactctcgattttaaaacctttggcgcagacacacaaagtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgat

SEQ ID NO: 189720 - DNA, 2100 bp, Homo sapiens
  Payload ID: 17463
  Gene Symbol: TBX22
  Gene Name: T-box 22
  ENST ID: ENST00000628739
  CDS Start-End: 1-215
ctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggttcggttctgcccaagctgttcacaagggtcacacacattaggcacttaatttaccgctctggcggatgttcccctctgttcgggtcaaggtgaaagggttggatccagggaagcagtaccatgtggccatcgatgtggtgccggtggattccaaacgctataggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacagattacgaaactaaaaatagaaagaaatccttttgctaaaggatttagagatactggaagaaacaggggtgtattggatgggcttttagagacctacccatggaggccttctttcactctcgattttaaaacctttggcgcagacacacaaagtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgatactccaccagtgaaaattgatgctaagtgatgggattttcaattatactgaagctagttcaccacgttaactgcattttacacattgacaatgacaaaaagaagatggatgtaattctcatgaaagcagtgaagcaatttcagttttaaaaatgaagatcggctttcatgtaattatctagtagttgtagaagaaaatttaattatttgtttgcctcatgcctttatactttgctgttgaagaaactactaatctcaatttaagatacaaataaggacacaaactttcaagtattatattttatttatctttgtagcctaaagaccatttaatcttgaaggaacacaaagatcaaatgaaaagtaaaacactctaaataaatttgcttttattttc

SEQ ID NO: 189721 - DNA, 2249 bp, Homo sapiens; identical to SEQ ID NO: 189716
  Payload ID: 17463
  Gene Symbol: TBX22
  Gene Name: T-box 22
  Uniprot ID: Q9Y458
  ENST ID: ENST00000628957
  CDS Start-End: 29-1591

SEQ ID NO: 189722 - DNA, 1955 bp, Homo sapiens; identical to SEQ ID NO: 189719
  Payload ID: 17463
  Gene Symbol: TBX22
  Gene Name: T-box 22
  ENST ID: ENST00000626498
  CDS Start-End: 135-518

SEQ ID NO: 189723 - DNA, 4208 bp, Homo sapiens
  Payload ID: 17464
  Gene Symbol: TBX3
  Gene Name: T-box 3
  Uniprot ID: O15119
  ENST ID: ENST00000257566
  CDS Start-End: 391-2622
gcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactttggccttcccaagtgatcacgctacgtggcaggggaattatagttttggtactcagactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtc

SEQ ID NO: 189724 - DNA, 4723 bp, Homo sapiens
  Payload ID: 17464
  Gene Symbol: TBX3
  Gene Name: T-box 3
  Uniprot ID: O15119
  ENST ID: ENST00000349155
  CDS Start-End: 965-3136
gaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtct

SEQ ID NO: 189725 - DNA, 2430 bp, Homo sapiens
  Payload ID: 17464
  Gene Symbol: TBX3
  Gene Name: T-box 3
  ENST ID: ENST00000613550
  CDS Start-End: 262-2430
tcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctccctgcggcagcctccagctcggtgcaccgccccccttctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtag

SEQ ID NO: 189726 - DNA, 2470 bp, Homo sapiens
  Payload ID: 17465
  Gene Symbol: TBX4
  Gene Name: T-box 4
  Uniprot ID: P57082
  ENST ID: ENST00000240335
  CDS Start-End: 46-1683
tgtggacctgggcgagtgactcgttgtgtgctgtgcccgcaggagatgctgcaggataagggcctgtccgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcagaccatcgagaacatcaaggtggggctgcatgagaaggagctctggaagaagttccacgaggcgggcaccgagatgatcatcactaaggctggcaggaggatgttccccagctacaaggtaaaagtcacaggcatgaaccccaagaccaagtatatcctgctgattgacattgtccctgccgatgaccatcgctacaagttctgtgacaacaaatggatggtggcagggaaggctgagccagccatgccaggaaggctgtatgtccacccggattctcctgccacaggagcccactggatgcggcagctggtctccttccagaagctgaagctgacaaacaaccacctggacccctttggccatatcatcctcaactctatgcacaagtaccagccgcggctccacatcgttaaggctgatgagaacaatgctttcggctccaaaaacactgctttctgcacccacgtgttcccagagacctccttcatctctgtgacctcctaccagaatcacaagatcacccagctgaaaattgagaacaacccttttgccaagggattccggggcagtgatgacagtgacctgcgtgtggcccgactgcagagcaaagaataccccgtgatttccaaaagcatcatgaggcagaggctcatctccccccagctctcagccacaccggacgtgggccccctgctcggcacccaccaggcactccagcactaccagcacgagaacggggcacactcacagctcgcggagccgcaggacctgcccctcagcacctttcccacccagagggactcaagcctcttctatcactgcctgaaaagacgagacggtacccgccacctggacttaccttgcaagcgatcctatctggaagccccctcttcggtgggggaggatcactatttccgttccccccctccctacgaccagcaaatgctgagcccctcctactgcagtgaggtgacccccagagaagcatgtatgtactcaggttcagggcccgagattgccggggtgtctggggtggacgacctgcccccacctccgctgagctgtaacatgtggacttcagtgtcgccgtacaccagctatagcgtgcagacgatggagactgtgccgtaccagcccttccccacgcacttcaccgccaccaccatgatgccgcggctgcccaccctctccgctcagagctcccagccaccaggaaatgcccactttagtgtctacaatcagctctcccagtctcaggtccgagagcgggggcccagcgcctcattcccaagagagcgcggcctcccccaagggtgtgagaggaagccaccctcgccacatctaaatgctgccaatgagtttctctactctcaaaccttctccttgtcccgagaatcttccttacagtaccattcaggaatggggactgtggagaactggactgacggatgactctcacgtctcctccatagccccgggaccgtgttgctccagtattaacctctgtgggtggcctgcactctaccaagaaacacaggaaggtattccagtgtgtgtgtgtgtgtgtgtgtgtgtgtgtgtgtgtgtgtatacacgagcatgtatgtatttggagagcatccatcttctgacatacaactgaggtcatgacaaggaaaaaaaacaccacatttatctaagaagtgattttggctgcaggacctgggtctattgttatctgacatctcttgacatgcccgtgggtgggatgggagtggagggttcatatgagttattgagagggttttataatggttgatttactcaggggccaggtggggagttctctcccatggggaaagattctcactgctggggtgggaagattctcgctgctggggtgtgaggactctgtgcacaccttagagttcctggccttctctttgcaaggggagctgagaatctggttttggtagcaggaggcccactcctttgacttctggagagtctgtgagactgcctgagaggtgggctcagctaagccacaatgtgtactttgatagtacagctggctgctcagtgagtggcctagacattgatgactggagctctgaggtctgagggatgacgttcggaaagggtcatgggctaaatgtcacctgaggggtatttttaaagggtttttttttcccttcaagaggagggaaaatgcaaccagtagcatctctgtcatcattcagattttgtaataaagtacaga

SEQ ID NO: 189727 - DNA, 3398 bp, Homo sapiens
  Payload ID: 17465
  Gene Symbol: TBX4
  Gene Name: T-box 4
  Uniprot ID: P57082
  ENST ID: ENST00000393853
  CDS Start-End: 164-1804
ctccagagccgggatgtgtccagccccgagggcacggcaggcagctggaccctgacccagcggcgcggagtcggagccccggccgtcccgcgctcctcggacccgaacctgcaggggacctcgggccgctggcgcctccgcatgcggcaccgcaattagggagatgctgcaggataagggcctgtccgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcagaccatcgagaacatcaaggtggggctgcatgagaaggagctctggaagaagttccacgaggcgggcaccgagatgatcatcactaaggctggcaggaggatgttccccagctacaaggtaaaagtcacaggcatgaaccccaagaccaagtatatcctgctgattgacattgtccctgccgatgaccatcgctacaagttctgtgacaacaaatggatggtggcagggaaggctgagccagccatgccaggaaggctgtatgtccacccggattctcctgccacaggagcccactggatgcggcagctggtctccttccagaagctgaagctgacaaacaaccacctggacccctttggccatatcatcctcaactctatgcacaagtaccagccgcggctccacatcgttaaggctgatgagaacaatgctttcggctccaaaaacactgctttctgcacccacgtgttcccagagacctccttcatctctgtgacctcctaccagaatcacaagatcacccagctgaaaattgagaacaacccttttgccaagggattccggggcagtgatgacagtgacctgcgtgtggcccgactgcagagcaaagaataccccgtgatttccaaaagcatcatgaggcagaggctcatctccccccagctctcagccacaccggacgtgggccccctgctcggcacccaccaggcactccagcactaccagcacgagaacggggcacactcacagctcgcggagccgcaggacctgcccctcagcacctttcccacccagagggactcaagcctcttctatcactgcctgaaaagacgagcagacggtacccgccacctggacttaccttgcaagcgatcctatctggaagccccctcttcggtgggggaggatcactatttccgttccccccctccctacgaccagcaaatgctgagcccctcctactgcagtgaggtgacccccagagaagcatgtatgtactcaggttcagggcccgagattgccggggtgtctggggtggacgacctgcccccacctccgctgagctgtaacatgtggacttcagtgtcgccgtacaccagctatagcgtgcagacgatggagactgtgccgtaccagcccttccccacgcacttcaccgccaccaccatgatgccgcggctgcccaccctctccgctcagagctcccagccaccaggaaatgcccactttagtgtctacaatcagctctcccagtctcaggtccgagagcgggggcccagcgcctcattcccaagagagcgcggcctcccccaagggtgtgagaggaagccaccctcgccacatctaaatgctgccaatgagtttctctactctcaaaccttctccttgtcccgagaatcttccttacagtaccattcaggaatggggactgtggagaactggactgacggatgactctcacgtctcctccatagccccgggaccgtgttgctccagtattaacctctgtgggtggcctgcactctaccaagaaacacaggaaggtattccagtgtgtgtgtgtgtgtgtgtgtgtgtgtgtgtgtgtgtgtatacacgagcatgtatgtatttggagagcatccatcttctgacatacaactgaggtcatgacaaggaaaaaaaacaccacatttatctaagaagtgattttggctgcaggacctgggtctattgttatctgacatctcttgacatgcccgtgggtgggatgggagtggagggttcatatgagttattgagagggttttataatggttgatttactcaggggccaggtggggagttctctcccatggggaaagattctcactgctggggtgggaagattctcgctgctggggtgtgaggactctgtgcacaccttagagttcctggccttctctttgcaaggggagctgagaatctggttttggtagcaggaggcccactcctttgacttctggagagtctgtgagactgcctgagaggtgggctcagctaagccacaatgtgtactttgatagtacagctggctgctcagtgagtggcctagacattgatgactggagctctgaggtctgagggatgacgttcggaaagggtcatgggctaaatgtcacctgaggggtatttttaaagggtttttttttcccttcaagaggagggaaaatgcaaccagtagcatctctgtcatcattcagattttgtaataaagtacagagcccttccccctaggtccccaacatacagtctctcactctggtgtgtggagagtcagcctcccaggcaccataccatctgcatcctatgatgatgggcaattatgaaacacgcctcagctggcatcatccccaggaggccacactggagctgatgtctggcatctccagggcctgttctgctctcagaaaatctacgcttctggagcgagaaaggccaacagaaataaagatagttgaaaaaaatttgtttcttccagtaaattcagccggtgagctcagaggagcaaagagaattctccagtgtggcgctcacaaagtcctcagccctgcgttttagcattgaataccaccaggccatcagtgtggctggggtgaactctccatcaaacttgggaaatcactaaactctttgcatgctgaatagctatttatatattatataaataaataaatatatatattatatatcgctctctctcacaaatgcaggccacatgtcaaattcagctttgctttctacaaatgaatgaacttaataaaaataaacgttggagggggtatttggaaagacatctatttaaatttttattacatgtttgatattaaaaactaagaatggtttagataaaacatataaataaatatatatatatatatatatatatataaacacacacacactacagataaggcttttttagaaaacacattagctaacaggtgatatggaacttcaagtgttttgttatatagcatggatgttttattttgcatatcggaacataaagccattttacaactgtgaa

SEQ ID NO: 189728 - DNA, 584 bp, Homo sapiens
  Payload ID: 17465
  Gene Symbol: TBX4
  Gene Name: T-box 4
  ENST ID: ENST00000589003
  CDS Start-End: 180-584
agatcaagggcccgctccagagccgggatgtgtccagccccgagggcacggcaggcagccccccgggacccggggccgacgtcgtcgccgccgccgccgcggagcagaccatcgagaacatcaaggtggggctgcatgagaaggagctctggaagaagttccacgaggcgggcaccgagatgatcatcactaaggctggcaggaggatgttccccagctacaaggtaaaagtcacaggcatgaaccccaagaccaagtatatcctgctgattgacattgtccctgccgatgaccatcgctacaagttctgtgacaacaaatggatggtggcagggaaggctgagccagccatgccaggaaggctgtatgtccacccggattctcctgccacaggagcccactggatgcggcagctggtctccttccagaagctgaagctgacaaacaaccacctggacccctttggccatatcatcctcaactctatgcacaagtaccagccgcggctccacatcgttaaggctgatgagaacaatgctttcggctccaaaaacactgctttctgcacccacgtgttcccagag

SEQ ID NO: 189729 - DNA, 3825 bp, Homo sapiens
  Payload ID: 17466
  Gene Symbol: TBX5
  Gene Name: T-box 5
  Uniprot ID: Q99593
  ENST ID: ENST00000310346
  CDS Start-End: 668-2224
catgccttatgcaagagacctcagtcccccggaacaactcgatttccttccaatagaggtctgaggtggactcccacctcccttcgtgaagagttccctcctctcccccttcctaagaaagtcgatcttggctctatttgtgtcttatgttcatcaccctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggagagcagaaccttgcgcgggcacagggccctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacggacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttccctagtgcgtagttggagtctgtccctgtcttggtgttaatgttgacattgttatataataaatgataatatatttttttctttcaattttcttaatgggacccagtcccttatttggggggaggtctgaggcaagtatatttcaaaatatgtacttgcgggattcccttcaagtaaaccatccctgaaacctaaattcacgtttccccttgactaagaaaagcacctacctctgccatgtgatgtttctgaaaagcctctgtatgtccccatttgctttggttttgtcctgccttctccaatatcacgtgctcagttttgcctctacttacccatggagtcaggataacactgacgctccctggcatcctatcttattcagccctaccatcttgccagctctgtctttccagctgtctgtcgctaaaacgtggcctatagcttcccttccggaaagcttgctttgaaaaacttaaaaagcccccgtttacatgtaggcaggactgtgataacagtgcaagctctgtgttgacaagagttgtggacaaaaagccaaaataaatattcttcctgattaaaaaaattttttttgaaaaaaacaaggccagccccaaccttccaaacctccatcaccaacaacccaaactggatgtcaagcaaaatgcacaattcctacagaagaggcaagacacagtcaccaatgatatctcgccaaagaaaccacgcccacaccaatgccaacacaaaactgtgtttactgaaagccgaaaacagtattaaaaaaagtgtgtaagtaaagtgttatggtagggttcttcagatgtaatattttactggtactatttatttataaataggaattctaattaagtaataacatgaaatgaaacccagcataggagctggccaagagcttttaattttattgatactcaaaaccaagtttgtgtttttttgtttttttttgtttttttcctctttcgaatgtgctttgctttttttgattaaaaagaattttttttttccttttttataaacagaccctaataaagagaacagggtaagatgtgaggctgagtgtgtttaagtacgtgagagagtgtgagtgtgtttgtaagtgagtgtccctatgcgattatgtctctttacgttgctaaggggggagggtgaggattaagtactcgtgccttatatttgtgtgccaattaatgcctaataaataccatgtgcttaaacaagt

SEQ ID NO: 189730 - DNA, 3585 bp, Homo sapiens
  Payload ID: 17466
  Gene Symbol: TBX5
  Gene Name: T-box 5
  Uniprot ID: Q99593
  ENST ID: ENST00000349716
  CDS Start-End: 578-1984
gaggtctgaggtggactcccacctcccttcgtgaagagttccctcctctcccccttcctaagaaagtcgatcttggctctatttgtgtcttatgttcatcaccctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacggacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttccctagtgcgtagttggagtctgtccctgtcttggtgttaatgttgacattgttatataataaatgataatatatttttttctttcaattttcttaatgggacccagtcccttatttggggggaggtctgaggcaagtatatttcaaaatatgtacttgcgggattcccttcaagtaaaccatccctgaaacctaaattcacgtttccccttgactaagaaaagcacctacctctgccatgtgatgtttctgaaaagcctctgtatgtccccatttgctttggttttgtcctgccttctccaatatcacgtgctcagttttgcctctacttacccatggagtcaggataacactgacgctccctggcatcctatcttattcagccctaccatcttgccagctctgtctttccagctgtctgtcgctaaaacgtggcctatagcttcccttccggaaagcttgctttgaaaaacttaaaaagcccccgtttacatgtaggcaggactgtgataacagtgcaagctctgtgttgacaagagttgtggacaaaaagccaaaataaatattcttcctgattaaaaaaattttttttgaaaaaaacaaggccagccccaaccttccaaacctccatcaccaacaacccaaactggatgtcaagcaaaatgcacaattcctacagaagaggcaagacacagtcaccaatgatatctcgccaaagaaaccacgcccacaccaatgccaacacaaaactgtgtttactgaaagccgaaaacagtattaaaaaaagtgtgtaagtaaagtgttatggtagggttcttcagatgtaatattttactggtactatttatttataaataggaattctaattaagtaataacatgaaatgaaacccagcataggagctggccaagagcttttaattttattgatactcaaaaccaagtttgtgtttttttgtttttttttgtttttttcctctttcgaatgtgctttgctttttttgattaaaaagaattttttttttccttttttataaacagaccctaataaagagaacagggtaagatgtgaggctgagtgtgtttaagtacgtgagagagtgtgagtgtgtttgtaagtgagtgtccctatgcgattatgtctctttacgttgctaaggggggagggtgaggattaagtactcgtgccttatatttgtgtgccaattaatgcctaataaataccatgtgcttaaacaagt

SEQ ID NO: 189731 - DNA, 2203 bp, Homo sapiens
  Payload ID: 17466
  Gene Symbol: TBX5
  Gene Name: T-box 5
  Uniprot ID: Q99593
  ENST ID: ENST00000405440
  CDS Start-End: 496-2052
ttcagagagagagagagagggagagagagtgagagagactgactcttacctcgaatccgggaactttaatcctgaaagctgcgctcagaaaggacttcgaccattcactgggcttccaactttccctccctgggggtgtaaaggaggagcggggcactgagattatatggttgccggtgctcttggaggctattttgtgttctttggcgcttgccaactgggaagtatttagggagagcaagcgcacagcagaggaggtgtgtgttggaggtgggcagtcgccgcggaggctccagcggtaggtgcgccctagtaggcagcagtagccgctattctgggtaagcagtaaaccccgcataaaccccggagccaccatgcctgctcccccgcctcaccgccggcttccctgctaggagcagcagaggatgtggtgaatgcaccggcttcaccgaacgagagcagaaccttgcgcgggcacagggccctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacggacaagatttttcatttcacccaatgttcacatctgcactcaaggtcgctggat

SEQ ID NO: 189732 - DNA, 1050 bp, Homo sapiens
  Payload ID: 17466
  Gene Symbol: TBX5
  Gene Name: T-box 5
  Uniprot ID: Q99593
  ENST ID: ENST00000526441
  CDS Start-End: 1-1050
atggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaaggtgagtgtgatcacccctggtcaatttgctttctttcttaccttttcctttccttgggttgggggtga

SEQ ID NO: 189733 - DNA, 1796 bp, Homo sapiens
  Payload ID: 17467
  Gene Symbol: TBX6
  Gene Name: T-box 6
  Uniprot ID: O95947
  ENST ID: ENST00000279386
  CDS Start-End: 57-1367
tctcgcagcaccgggggccctaagcagcgagacctgaggccagacggaactacaacatgtaccatccacgagaattgtacccgtccctgggggccggctaccgcctggggcccgcccaacctggggccgactccagcttcccacccgccctagcggagggctaccgctaccccgaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacctgatcctgcactccatgcacaagtaccaaccccgcatacacctagttcgggcagcccagctctgcagccagcactgggggggcatggcctccttccgcttccccgagaccacattcatctccgtgacagcctaccagaacccacagatcacacaactgaagattgcagccaatccctttgccaaaggcttccgggagaacggcagaaactgtaagagggagcgagacgcccgtgtgaagaggaaactgcggggcccagagccagcagccacagaggcctatgggagcggagacacaccaggtggtccctgcgactccaccctgggtggagacattcgtgaatcagatccagaacaggccccagcccccggggaagccaccgctgccccggcacctctgtgtggtggccccagtgctgaggcctacctcctgcaccctgcggctttccatggggcccccagtcaccttcccaccaggagccccagcttcccggaggctccagactccgggcgctcagccccctactcggctgcatttctggagctgccgcacgggtcagggggctccgggtacccagcggctccaccggcggtaccctttgccccgcactttctccaagggggccccttccctctaccatacaccgcgcctgggggctatctggatgtgggctccaaacccatgtactgaaccactgctgggcccctctgcctccatcacaaacctcccgctcccttcccccagccctggagccccctcacctccaccggccccatcccccacaccaaatggccgccttgggcctgcccacccaccccctcaacttcacaccttgatttcactcccacccccctctggcttcaaagcctaaccaaggctgctgggagtccagctggggccggcttccccttcccggctctcacctccgtgtgaatggaaggggctctgcctggccaaatggggccacagaccagcatccccacttaccaggcctccccatgggctctggaggggctcaatccccacccccccacacacactggtgcaggccacaccagtctgttgttctgggaccagagtatttttgttaataaaactcaaaagccatccatgctcagg

SEQ ID NO: 189734 - DNA, 1803 bp, Homo sapiens
  Payload ID: 17467
  Gene Symbol: TBX6
  Gene Name: T-box 6
  Uniprot ID: O95947
  ENST ID: ENST00000395224
  CDS Start-End: 61-1371
agctgtcggactcaccgggggccctaagcagcgagacctgaggccagacggaactacaacatgtaccatccacgagaattgtacccgtccctgggggccggctaccgcctggggcccgcccaacctggggccgactccagcttcccacccgccctagcggagggctaccgctaccccgaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacctgatcctgcactccatgcacaagtaccaaccccgcatacacctagttcgggcagcccagctctgcagccagcactgggggggcatggcctccttccgcttccccgagaccacattcatctccgtgacagcctaccagaacccacagatcacacaactgaagattgcagccaatccctttgccaaaggcttccgggagaacggcagaaactgtaagagggagcgagacgcccgtgtgaagaggaaactgcggggcccagagccagcagccacagaggcctatgggagcggagacacaccaggtggtccctgcgactccaccctgggtggagacattcgtgaatcagatccagaacaggccccagcccccggggaagccaccgctgccccggcacctctgtgtggtggccccagtgctgaggcctacctcctgcaccctgcggctttccatggggcccccagtcaccttcccaccaggagccccagcttcccggaggctccagactccgggcgctcagccccctactcggctgcatttctggagctgccgcacgggtcagggggctccgggtacccagcggctccaccggcggtaccctttgccccgcactttctccaagggggccccttccctctaccatacaccgcgcctgggggctatctggatgtgggctccaaacccatgtactgaaccactgctgggcccctctgcctccatcacaaacctcccgctcccttcccccagccctggagccccctcacctccaccggccccatcccccacaccaaatggccgccttgggcctgcccacccaccccctcaacttcacaccttgatttcactcccacccccctctggcttcaaagcctaaccaaggctgctgggagtccagctggggccggcttccccttcccggctctcacctccgtgtgaatggaaggggctctgcctggccaaatggggccacagaccagcatccccacttaccaggcctccccatgggctctggaggggctcaatccccacccccccacacacactggtgcaggccacaccagtctgttgttctgggaccagagtatttttgttaataaaactcaaaagccatccatgctcaggaaa

SEQ ID NO: 189735 - DNA, 1543 bp, Homo sapiens
  Payload ID: 17467
  Gene Symbol: TBX6
  Gene Name: T-box 6
  Uniprot ID: O95947
  ENST ID: ENST00000567664
  CDS Start-End: 21-908
aggccagacggaactacaacatgtaccatccacgagaattgtacccgtccctgggggccggctaccgcctggggcccgcccaacctggggccgactccagcttcccacccgccctagcggagggctaccgctaccccgaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacctgatcctgcactccatgcacaagtaccaaccccgcatacacctagttcgggcagcccagctctgcagccagcactgggggggcatggcctccttccgcttccccgagaccacattcatctccgtgacagcctaccagaacccacagatcacacaactgaagattgcagccaatccctttgccaaaggcttccgggagaacggcagaaactgtaagaggtgggagttgttcattcatttgttcatgcattcaacaaatgtttattaatcactcactgtgtgccaggcaccgtgctggacatcagaaatgcagtgacacaccaggtggtccctgcgactccaccctgggtggagacattcgtgaatcagatccagaacaggccccagcccccggggaagccaccgctgccccggcacctctgtgtggtggccccagtgctgaggcctacctcctgcaccctgcggctttccatggggcccccagtcaccttcccaccaggagccccagcttcccggaggctccagactccgggcgctcagccccctactcggctgcatttctggagctgccgcacgggtcagggggctccgggtacccagcggctccaccggcggtaccctttgccccgcactttctccaagggggccccttccctctaccatacaccgcgcctgggggctatctggatgtgggctccaaacccatgtactgaaccactgctgggcccctctgcctccatcacaaacctcccgctcccttcccccagccctggagccccctcacctccaccggccccatcccccacaccaaatggccgccttgggcctgcccacccaccccctcaacttcacaccttgatttcactcccacccccctctggcttcaaagcctaaccaaggctg

SEQ ID NO: 189736 - DNA, 2162 bp, Homo sapiens
  Payload ID: 17467
  Gene Symbol: TBX6
  Gene Name: T-box 6
  Uniprot ID: O95947
  ENST ID: ENST00000553607
  CDS Start-End: 695-1582
agaagctgtcggactgtgagcgccttcgaactttggaggcttggctcgggatggaggtttttttagcatggggaccagggaggactacggtgctcgggactgggctgcggcctcctcgcggccccgagtgccctgtgaaatcagctcaggccgcgtccctctagcctgcactttccctctgttcacgctgcttccctccagggcccggcctccaagtgaaggggggcggagggcggtcacctgccagaaggtctggggcgccaaggtgtgtcccgggactcttggctccgtccaggttccaggccccgccccccagcttatccctagccggggctccccaccgtgggaacggggaccagctggccggaagcgccaaactgcgtccctgtccgagccctggggatcaatcaagccgaggagttaattatgtaatgagggggcagggggtcgaggctaatgaagcctcccggggtggggagggaggggaggaggggaccgtacccaggtatccgaccccctctcggaccccttcgaggccccaggggtctccaccccagcccaactccagggccccaaagaggggaggggctgtgatcctggatctggaaggggctgagctgtgagctataaagggggcatctcgcagcaccgggggccctaagcagcgagacctgaggccagacggaactacaacatgtaccatccacgagaattgtacccgtccctgggggccggctaccgcctggggcccgcccaacctggggccgactccagcttcccacccgccctagcggagggctaccgctaccccgaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacctgatcctgcactccatgcacaagtaccaaccccgcatacacctagttcgggcagcccagctctgcagccagcactgggggggcatggcctccttccgcttccccgagaccacattcatctccgtgacagcctaccagaacccacagatcacacaactgaagattgcagccaatccctttgccaaaggcttccgggagaacggcagaaactgtaagaggtgggagttgttcattcatttgttcatgcattcaacaaatgtttattaatcactcactgtgtgccaggcaccgtgctggacatcagaaatgcagtggtaagtgaaaacattcattcactgactcagcaaatacttatatagtacctgctatgtgccagggacagttccaggcactggagataaaacaaacaaagcaaaccaaagccccggccctcatgcagctgatttctagtggggagagtagacaagcagacaagagaaataaataaaatgtcatctgttaggaagccattctaaagagaagagagaccaggtgtggtggctcacgcatgtaatcccagcactctgggaggctgaggcgggcagatcacctgaggccaggagttcgagaccagcctgccaacatggtgaaaccctgtctctgctaaaaatacaaaaattagccaggcatggtggcaaacgcctgtaatcccaactacttgggaggctgaggcaggagaatctcttgaacccaggaggtggaggttgcagtgagtcgagatcatgccattgcattccagcctaggcaacacgagcaaaacttcctctcaaaaaaaaaaaaaaaaagaaagaaaagaaaactctgtctc

SEQ ID NO: 189737 - DNA, 1796 bp, Homo sapiens
  Payload ID: 17467
  Gene Symbol: TBX6
  Gene Name: T-box 6
  ENST ID: ENST00000627355
  CDS Start-End: 57-1367
tctcgcagcaccgggggccctaagcagcgagacctgaggccagacggaactacaacatgtaccatccacgagaattgtacccgtccctgggggccggctaccgcctggggcccgcccaacctggggccgactccagcttcccacccgccctagcggagggctaccgctaccccgaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacctgatcctgcactccatgcacaagtaccaaccccgcatacacctagttcgggcagcccagctctgcagccagcactgggggggcatggcctccttccgcttccccgagaccacattcatctccgtgacagcctaccagaacccacaggtgagtgaccctgctgggggtggtggccccctgcccagaccatcatcatcatcaccaccactgttccccagggagcgagacgcccgtgtgaagaggaaactgcggggcccagagccagcagccacagaggcctatgggagcggagacacaccaggtggtccctgcgactccaccctgggtggagacattcgtgaatcagatccagaacaggccccagcccccggggaagccaccgctgccccggcacctctgtgtggtggccccagtgctgaggcctacctcctgcaccctgcggctttccatggggcccccagtcaccttcccaccaggagccccagcttcccggaggctccagactccgggcgctcagccccctactcggctgcatttctggagctgccgcacgggtcagggggctccgggtacccagcggctccaccggcggtaccctttgccccgcactttctccaagggggccccttccctctaccatacaccgcgcctgggggctatctggatgtgggctccaaacccatgtactgaaccactgctgggcccctctgcctccatcacaaacctcccgctcccttcccccagccctggagccccctcacctccaccggccccatcccccacaccaaatggccgccttgggcctgcccacccaccccctcaacttcacaccttgatttcactcccacccccctctggcttcaaagcctaaccaaggctgctgggagtccagctggggccggcttccccttcccggctctcacctccgtgtgaatggaaggggctctgcctggccaaatggggccacagaccagcatccccacttaccaggcctccccatgggctctggaggggctcaatccccacccccccacacacactggtgcaggccacaccagtctgttgttctgggaccagagtatttttgttaataaaactcaaaagccatccatgctcagg

SEQ ID NO: 189738 - DNA, 4009 bp, Homo sapiens
  Payload ID: 17468
  Gene Symbol: TBR1
  Gene Name: T-box, brain, 1
  Uniprot ID: Q16650
  ENST ID: ENST00000389554
  CDS Start-End: 318-2366
gtcgctaccaggagccaggtgattatcctaattaatgtctatctaattaaattactgtcagcagctaaccaatggcaggagccgtttcatcggctgcacaagcagcaagatcaaaagtgagccttttctgattgctgcatagtgtcaattggccaatctcttctcccagggaaaaaaaaaagtaaatcaaacctttgagaagcatttgctggttgaagtgctttctgtctagtgagggggtctgtggatttctagtttatgataaataggactttaaaaaccagggacgggagggcgagtgttcaggttctagagctatgcagctggagcactgcctttctccttctatcatgctctccaagaaatttctcaatgtgagcagcagctacccacattcaggcggatccgagcttgtcttgcacgatcatcccattatctcgaccactgacaacctggagagaagttcacctttgaaaaaaattaccagggggatgacgaatcagtcagatacagacaattttcctgactccaaggactcaccaggggacgtccagagaagtaaactctctcctgtcttggacggggtctctgagcttcgtcacagtttcgatggctctgctgcagatcgctacctcctctctcagtccagccagccacagtctgcggccactgctcccagtgccatgttcccgtaccccggccagcacggaccggcgcaccccgccttctccatcggcagccctagccgctacatggcccaccacccggtcatcaccaacggagcctacaacagcctcctgtccaactcctcgccgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggcgcatgtttccttttttaagttttaacatttctggtctcgatcccacggctcattacaatatttttgtggatgtgattttggcggatcccaatcactggaggtttcaaggaggcaaatgggttccttgcggcaaagcggacaccaatgtgcaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctgcccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttggttttcctacttactcttcttctgtggagttatcctcctacaattcccctccccctcgtctttctcttacctcctacttctctttcttgtaatgaaactcttcacctttaggagacctgggcagtcctgtcaggcagcagcgattccgacccgccaagtctcggcctccacattaaccataggatgttgactctagaacctggacccacccagcgcgtcctttcttatccccgagtggatggatggatggatggatggtagggatgttaataattttagtggaacaaagcctgtgaaatgattgtacatagtgttaatttattgtaacgaatggctagtttttattctcgtcaaggcacaaaaccagttcatgcttaacctttttttcctttcctttctttgcttttctttctctcctctcatactttctcttctctctcttttaattttcttgtgagataatattctaagaggctctagaaacatgaaatactcagtagtgatgggtttcccacttctcctcaatccgttgcatgaaataattactatgtgccctaatgcacacaaatagctaaggagaatccacccaaacacctttaaaggataggtgtctgttcataggcaagtcgattaagtggcatgatgcctgcaaagcaaagtcaactggagttgtatgttccccccaccttctaaatagaatagctcgacatcagcaatattattttgccttatttgtttttccccaaagtgccaaatccattactggtctgtgcaggtgccaaatatgctgacaaactgtttctgaatatctttcagtaccccttcacctttatatgctgtaaatctttgtaatgaatactctattaatgatatagatgactgaattgttggtaactatagtgtagtctagtgaagatgaattgtgtgagttgtatattttactgcattttagttttgaaaatgacttccccaccacctagaaacagctgaaatttgacttccttgggagaacactagcattaatgcaagtaagactgattttcccctaagtcttgttatatttgataaggagcattaatccccctggaaatagattagtaggatttctaatgttgtgtagcaaacctatacttttttgtatttaaaaattaatgtgaaatatgcatcatacacaatattcaatctagattccagtccatggggggatttttcctaataggaattcagggtctaaacgtgtgtatattttggctcttctgtaaatctaatgttgtgatttttatatttgtttcgttttgtctgtgaactgaataatttatacaagaacacactccattgagaaacgttttgttttttgctcgtttgtatcgtctgtgtataacaagtaaaataaacctggtaaaaacgctaa

SEQ ID NO: 189739 - DNA, 1454 bp, Homo sapiens
  Payload ID: 17468
  Gene Symbol: TBR1
  Gene Name: T-box, brain, 1
  Uniprot ID: Q16650
  ENST ID: ENST00000410035
  CDS Start-End: 208-1395
tttgtggactggctcgagcgacttttaaaacgatcggccaatgacttctaaaaggaaacgagggggacagggggacagactgagctgcgagaagggggaggattatgcaaaagctattttaatcacccccagttaataggaagaaagaatggcctaaaaaagccccagttaatgggcttcatggtggagtaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctgcccgcccggccccgccgcggcccggacccccagccagcccctcacagct

SEQ ID NO: 189740 - DNA, 698 bp, Homo sapiens
  Payload ID: 17468
  Gene Symbol: TBR1
  Gene Name: T-box, brain, 1
  ENST ID: ENST00000411412
  CDS Start-End: 1-698
tttcaaggaggcaaatgggttccttgcggcaaagcggacaccaatgtgcaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttccaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactgg

SEQ ID NO: 189741 - DNA, 4228 bp, Homo sapiens
  Payload ID: 17469
  Gene Symbol: TBPL1
  Gene Name: TBP-like 1
  Uniprot ID: P62380
  ENST ID: ENST00000237264
  CDS Start-End: 276-836
atttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagatctctcttcattctataacttttattccccattttctattttaacaaaaattgtattcatacttcttttttttaaaatctatgcaagcttaagactttggctaaagtgtgttggcttctttttgaagtgtattttgtgtgtgtgtgtgtgtgtgtgtgtatatatatatatatatatgcaccacatgtgtatagtatcttttaatgctctgttaccaaataacaaataggaattttttttcttgcagattagaaataaaaacgtgtatataaactctagggaaccagactagaagtttatagataaaggataatgttttatgttgctaatttaatatgatagaaaatgttaaataacttgtaaaggttaagaaattgtagttttaagaagagaaacctcttacccactagatggaaatgagaaagaagctgtgatgaatggtgcctcatttggacctttgtttttctggaaagactcaacacctgtagttgtagagaagtgattgaggttcttgactttaatcttgggttgatgcccaagcctatactaagagtcttgtcagaagttggtaacatggagatgttttaacaagaagtgcccataagctgcctctgtgccacagtgtaattatcaaatagccccacttgaatttgaaagccattttgtgtgatactgtccttccccttgctgtatcttatttaatggagttaaagagtgactattcagtatatgagattgctactcttaaagttataataaatatgcatttatgaaacagtgtctctggctcacccaggagccctgatgtggtaatacaggatcaagctgtagttgtgccctgtcatttaggtttaggagtttagtgtaaccaacagtgattatacctagaaataaagctgagtggagagtccaattagcttctcaggagaaacttaatggggacaatattccaacacaatgttccacaaaaacttgtatttccaaaatgtttttaaacctttgtggaaaaattgcaacatcctaatctccatatatagtacattttccttactgtattataaaatcttgaaaacctagcttaggcactgcactgaacaacacatattatttttatcttttttcttctcaatgccttccctaacctcctgcttattccaaagtggaaagcaaaggctaacttacatttttccttcttgtgaaatatttcattgagatttttagacttgtatttttccttttttttaaaaaaaaagtgtttatttcctttattttaagattcagtaggatagccaaattcatagagaataaaattacatgaaagagttacaagctcactgttttaaagacttgacatttttcatttagttttaattaacagtaataagtcacctcctgtttttcaatgttcaccaaaaaaagaaacatagaatagggggaaaacatgcttatatagccaaggtacagatccagatgatgtaacctttttagtattcgcatgacttgaaaactgggcagatcaatagataatcgaagtgctttatctgaagggagagggtaaagacagtgtgaccaggtttgttttcagggctgccgaatgagcctcacctaacagtgtccatgggtaattcgctaaccttaacaaagatgggaagaagtgagtgctctgatgtcttctgctggctctccataagtactgtaaattttttttataaataaaaactgtgaatatatatgtacaagttgtaagtatttccccctttttatttttgaaaatcaagaagcttgatttggtgtggtgcaatggatattggataaaaatttgaagacaaaattgtttagttacagactcaggataataaaagaaaaatataaaagaatgctcaagatactgaagtcaaggtcactagtaataaactggctaggttgataaacaatttcctgcccatttataatgaagggctaaacaaaaaatacctgaagtatatatagagtttgaactataaacacggaaggaaacatggggcagaacacacttcccttctctttccaaaaacaaaaaacaatgcatgctctgatttgcgtatgaaatacaccatgatagaattgagatctccaatctcctttccttttagcttccccctgccaatttttatacagataatacactgcagatccaggccttttagtcagtctcctgagtctctgatatagttttactacttacataggtttatagtctctccacattgttataaaggaatgtaatagatcatgtttccttatatgacattgggacagtttgttaggaaccaataggaaaattccaagctaaataaaaaggagctttggctcttaggattctcttttcttcaggttaatcatattttaaaattctttttcaagttaggttgttcgtgcttttaagttttttgtgtgtcttccatcacttaaatattagtaatttaatatgttatttggttcaagatttgattgtggattttctatcatacccaaattttattagtaagacctcttaacaagtctttaaaatcaactggagaagtaagagaacagttcatcgttgtgtgggtgaaacccacgttgctggtacaggtggccatcatagaaaagaacatgagggaattgtcctgatgtctgaatgtcatttattgtgtcttcagttatctgaacatcatcatcaattatagcctgtgtaccgtaacctgaggtagtgatattcctgaggagtgtgaagaattggacactgtggattactatacattgtcatgaaagccttacaaggaggcagcttttctaggcttgacttaataacttcaacctaattgcttagagatttggataaataacctaatggcctgactccttttctaatgttttactaacagctacttctaaataaatatggtcccaggattttaaaa

SEQ ID NO: 189742 - DNA, 623 bp, Homo sapiens
  Payload ID: 17469
  Gene Symbol: TBPL1
  Gene Name: TBP-like 1
  ENST ID: ENST00000367869
  CDS Start-End: 350-623
ctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggagcgaggtttcaccaggctggtctccaactcctgacctcaaatgatccacccatcttggcctcccagagtgctgagattacaggcgtgaggcaccactcctggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactag

SEQ ID NO: 189743 - DNA, 808 bp, Homo sapiens
  Payload ID: 17469
  Gene Symbol: TBPL1
  Gene Name: TBP-like 1
  ENST ID: ENST00000367871
  CDS Start-End: 276-767
atttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacaggtattctatgatattgaaaccacacttatcaattatggattgaatgatacaa

SEQ ID NO: 189744 - DNA, 865 bp, Homo sapiens
  Payload ID: 17469
  Gene Symbol: TBPL1
  Gene Name: TBP-like 1
  ENST ID: ENST00000457715
  CDS Start-End: 731-865
gggtcccccggcccctgcagggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacgcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttgga

SEQ ID NO: 189745 - DNA, 991 bp, Homo sapiens
  Payload ID: 17469
  Gene Symbol: TBPL1
  Gene Name: TBP-like 1
  ENST ID: ENST00000416965
  CDS Start-End: 606-991
ggccgttacgcgattttcgctcccgcgggcagcgcctctcaggccactcccgagggaccccgaggacgcactcgggccccagggcgacggttcaaacgggccattgtgcgcccccggggtcccccggcccctgcagggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccag

SEQ ID NO: 189746 - DNA, 1625 bp, Homo sapiens
  Payload ID: 17469
  Gene Symbol: TBPL1
  Gene Name: TBP-like 1
  Uniprot ID: P62380
  ENST ID: ENST00000613034
  CDS Start-End: 606-1166
ggccgttacgcgattttcgctcccgcgggcagcgcctctcaggccactcccgagggaccccgaggacgcactcgggccccagggcgacggttcaaacgggccattgtgcgcccccggggtcccccggcccctgcagggctacttgggcgcagagccgcggagggtctccgttcctagaggtcctcctatcccgggctgcctgagtcctcgccagcatccgccctctcccactcccatccttcctggatccgcctctcggttcccgagggacagtcccgaccgcaaacccacgtagagtaaggaatgtgggacaggcgacagaagtggcatacggtcctgcgttatccctccgtctcgccacaccttgtgtctccatctctccccacttccttccctccgtctgtcatctgtcatccccggtcgctctaagaccaggattccaattcgcctagtgaggaatctcactaggggaatttatcgcgacatcataaattaacgggttcattttgactgaaaaagcgaaggacttttttcaggcagaaaacaagtctcgtctggacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgttaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagatctctcttc

SEQ ID NO: 189747 - DNA, 4109 bp, Homo sapiens
  Payload ID: 17470
  Gene Symbol: TIPARP
  Gene Name: TCDD-inducible poly(ADP-ribose) polymerase
  Uniprot ID: Q7Z3E1
  ENST ID: ENST00000295924
  CDS Start-End: 497-2470
agacgcggaccctcagggacactgcggacgcgagaaaggacacgccccctcgcgggagcataagtccaccgcacagaactcgcgcgcctcccctcgaacgaacgcgcacgcgcgcgcagggggcgggtcttcttcccgacacccactgagcgcccggcctcctcaccccaccccaccgaactccggccgcccaggctccgcctccgcgacgggccgtcgggaggaggcgaccggaagccacttaaagcagagatcgaggtgacaggcgagctggctggactcggagcgcggtcgaggctttctgcgttcgcggcggcggaatggcccgtgcgcggctcgccgcgtcgcggctctgtggtccctagacgtcggctcccgccctcggcgctgatctccggcgcgggcactgctttccactcggctcctgtcgtccgttctctcaggctcccgttcaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccaaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaacttatggtaattctttaaaa

SEQ ID NO: 189748 - DNA, 2150 bp, Homo sapiens
  Payload ID: 17470
  Gene Symbol: TIPARP
  Gene Name: TCDD-inducible poly(ADP-ribose) polymerase
  Uniprot ID: Q7Z3E1
  ENST ID: ENST00000486483
  CDS Start-End: 169-2142
aaaagcataaagaatgtataacaacctaattgttacaagggagtggaattaataatctacaagaaggcacaaaaggacagaaaagaaacagaacaaatgagaaaaatagaaagccaacagtaatatggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatctt

SEQ ID NO: 189749 - DNA, 2035 bp, Homo sapiens
  Payload ID: 17470
  Gene Symbol: TIPARP
  Gene Name: TCDD-inducible poly(ADP-ribose) polymerase
  ENST ID: ENST00000481853
  CDS Start-End: 73-2035
caccattcctttctcacctggcacaatctcagatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactg

SEQ ID NO: 189750 - DNA, 1770 bp, Homo sapiens
  Payload ID: 17470
  Gene Symbol: TIPARP
  Gene Name: TCDD-inducible poly(ADP-ribose) polymerase
  ENST ID: ENST00000473702
  CDS Start-End: 252-1770
agagccgggcggcgcctcagctgcactgcgcggagttggcgcggcccgggaccaggagctgagcaaaccgccgcggccaacaggaggcgtcactcggacccgggctcggcgccggggtgtcgcgcggcggcgggcgggcaggctttggagcggcagttttttcggaaagtgcttttggccgggagtgccgcagaaccccagcgtcacgaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaat

SEQ ID NO: 189751 - DNA, 2700 bp, Homo sapiens
  Payload ID: 17470
  Gene Symbol: TIPARP
  Gene Name: TCDD-inducible poly(ADP-ribose) polymerase
  ENST ID: ENST00000495891
  CDS Start-End: 1-1081
cacaaacaagctggagcagcccagaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccaaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaa

SEQ ID NO: 189752 - DNA, 4181 bp, Homo sapiens
  Payload ID: 17470
  Gene Symbol: TIPARP
  Gene Name: TCDD-inducible poly(ADP-ribose) polymerase
  Uniprot ID: Q7Z3E1
  ENST ID: ENST00000461166
  CDS Start-End: 589-2562
agtgcgagcgccggcctcgcggctccggccccggccccggccccgcgccggcagtgtgcggggctctcgcggatcggggtgattgattttgagactgccctttgtaccgaattcactcgggtcccgtcagcatgaagatggaattggtttacacttcttaggcacttagagcctgtggcaggtgtatacatcagaccgaggcgccgaaggatttagttggggtcgcaggcgcctgccccttccccgttcgtcagggtgggggcgcgtctatgcggcctcccccgcgggccgaccccgggtgctctgaggcgcctaggagcccttcccagaccccgggggggagggcacggcagctacgggagccttccggctaccccgcgtttcgggctgcagcccagaagtttggaagatgttttcacattaactttgagagcgcacaagtcttcgtcttcctccccgccgccgcgggaagcgctcgccgcctttcccccgcgcttcgcggctcagttctgcgagcccccaagacccgttggacgctcctcgggaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccaaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaa

SEQ ID NO: 189753 - DNA, 3681 bp, Homo sapiens
  Payload ID: 17470
  Gene Symbol: TIPARP
  Gene Name: TCDD-inducible poly(ADP-ribose) polymerase
  Uniprot ID: Q7Z3E1
  ENST ID: ENST00000542783
  CDS Start-End: 73-2046
caccattcctttctcacctggcacaatctcagatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatggaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccaaattgataaggttattactgtgttttgcacaaagtatattagcaaaagtatttgctggaattattggtagatggcagtcccactcctacacctgctttgtcagatacagctgggttccctggctgactctgtaccttacttacactacttacttaatagaaacacaaacttggaaattgtgccagtggtccagctggagcacaacgtttggtgaatatgctgtttcctcagttcagagaggtagcaactaggtaaactccttataaaaagcaaatacctggatttacaaaagtgaaagtagttgttcacaaaagaattcgccatggaattctttcagttaccaagctctcctggtaatgtttgtggttatatcatttacacaaaacttttcaggaacttctgtgttgtttaagcaagatgtatctgtactgatgtctcagtgaatcagtctgtttattaagcacttatcagggcttccacacacttatttattttgccctagttaatcctgttgtttgctgccattggcatgaaatggccaactgtggctgttacagttctttcattcaattataacttgtaaaccagtgactcctaatctttttcaagttaagacaccttaccattgcttatttggttttatgagacttgttcctttttttctccctaaggaaaaagaaagctttatgacatatttatttttttaataaaactaagcaaaaataaaacttatggtaattcttt

SEQ ID NO: 189754 - DNA, 3051 bp, Homo sapiens
  Payload ID: 17471
  Gene Symbol: TAGAP
  Gene Name: T-cell activation RhoGTPase activating protein
  Uniprot ID: Q8N103
  ENST ID: ENST00000326965
  CDS Start-End: 700-2361
gacatagctgccctaaaaggaatgaggaagcgagagctctccagtgtctggctggctccgtccgtgtgacagcccatgatgttctttccggtctctgtaatattctgaatttccacctgcccgccccttcgcttataatgcagagcatgtgaagggagaccggctcggtctctctctctcccagtggactagaaggagcagagagttatgctgtttctcccattctttacagctcaccggatgtaaaagaactctggctagagaccctccaaggacagaggcacagccacacgggagtgaaatccacccctggacagtcagccgcaatactgatgaagctgagaagcagccacaatgcttcaaaaacactaaacgccaataatatggagacactaatcgaatgtcaatcagagggtgatatcaaggaacatcccctgttggcatcatgtgagagtgaagacagtatttgccagctcattggacattctcactattctatgccttaaaggcccttcaacggaagggatattcaggagagcagccaacgagaaagcccgtaaggagctgaaggaggagctcaactctggggatgcggtggatctggagaggctccccgtgcacctcctcgctgtggtctttaaggacttcctcagaagtatcccccggaagctactttcaagcgacctctttgaggagtggatgggtgctctggagatgcaggacgaggaggacagaatcgaggccctgaaacaggttgcagataagctcccccggcccaacctcctgctactcaagcacttggtctatgtgctgcacctcatcagcaagaactctgaggtgaacaggatggactccagcaatctggccatctgcattggacccaacatgctcaccctggagaatgaccagagcctgtcatttgaagcccagaaggacctgaacaacaaggtgaagacactggtggaattcctcattgataactgctttgaaatatttggggagaacattccagtgcattccagtatcacttctgatgactccctggagcacactgacagttcagatgtgtcgaccctgcagaatgactcagcctacgacagcaacgaccctgatgtggaatccaacagcagcagtggcatcagctctcccagcaggcagccccaggtgcccatggccacagctgctggcttggatagcgcgggcccacaggatgcccgagaggtcagcccagagcccattgtgagcaccgtggccaggctgaaaagctccctcgcacagcccgataggagatactcagagcccagcatgccatcctcccaggagtgcctcgagagccgggtgacaaaccaaacactaacaaagagtgaaggggacttccccgtgccccgggtaggctctcgtttggaaagtgaggaggctgaagacccatttccagaggaggtcttccctgcagtgcaaggcaaaaccaagaggccggtggacctgaagatcaagaacttggccccgggttcggtgctcccgcgggcactggttctcaaagccttctccagcagctcgctggacgcgtcctctgacagctcgcccgtggcttctccttccagtcccaaaagaaatttcttcagcagacatcagtctttcaccacaaagacagagaaaggcaagcccagccgagaaattaaaaagcactccatgtctttcacctttgcccctcacaaaaaagtgctgaccaaaaacctcagcgcgggctctgggaaatcgcaagactttaccagggaccacgtcccgaggggtgtcagaaaggaaagccagcttgccggccgaatcgtgcaggaaaatgggtgtgaaacccacaaccaaacagcccgcggcttctgcctgagaccccacgccctctcggtggatgatgtgttccagggagctgactgggagaggcctggaagcccaccctcttatgaagaggccatgcagggcccggcagccagactagtggcctccgagagccagaccgtggggagcatgacggtggggagcatgagggcgaggatgctggaggcgcactgcctcctaccccctcttccacctgctcaccacgtagaggactcaagacacaggggcagcaaagagccactccctggccacggactctctcccctgcctgagcgatggaaacagagcagaactgtccatgcttctggggactctctggggcacgtgtctggcccagggagacctgagctcctcccgctgaggaccgtctccgagtccgtgcagaggaataagcgggactgtctcgtgcgacgatgtagccagccggtctttgaggctgaccaattccaatatgccaaagaatcgtatatttaggagggaggccatacgccatgccatagcttgtgctatctgtaaatatgagacttgtaaagaactgcctgtagattgtttttaaaaggtcttgaataagctccttgagaaagttgtggaaagccctcctcagtgaggatagctacaccatggccatggcgcatcagatagtctctgtgtacctggatttgtgcaatatgtaaaaatgtatcaaatgtattatagataaggtgttaggtgcaaaggatgtctaataatccctgcacacgttttgaacttgcagtgaagtacactgctgttccttgcttcctggggcacttttctcttggttagtgtttaaaaattatcttcgcttttttaatgtggcctcaaatgtcatgccaattttcacatcttccacaaactccatttagggagaaatgtttaaatctctggtataagtttactccataccagagtaaactatatattactctatataagcagtcttgcaataactaatcaccaccatagaagaaagaaacagactgcaaggaacagagttgagtgtctggagtcatcaaaggcattaaaaactccagtaaaagctggggccgtagcaaaaatcatgaaaaacacttcaacgtgtcctttcaatcatccaattaaatgtgggtagattaatgaaaatgtattacatcaatattaactcat

SEQ ID NO: 189755 - DNA, 1183 bp, Homo sapiens
  Payload ID: 17471
  Gene Symbol: TAGAP
  Gene Name: T-cell activation RhoGTPase activating protein
  Uniprot ID: Q8N103
  ENST ID: ENST00000338313
  CDS Start-End: 199-999
ataatgcagagcatgtgaagggagaccggctcggtctctctctctcccagtggactagaaggagcagagagttatgctgtttctcccattctttacagctcaccggatgtaaaagaactctggctagagaccctccaaggacagaggcacagccacacgggagtgaaatccacccctggacagtcagccgcaatactgatgaagctgagaagcagccacaatgcttcaaaaacactaaacgccaataatatggagacactaatcgaatgtcaatcagagggtgatatcaaggaacatcccctgttggcatcatgtgagagtgaagacagtatttgccagctcattgaagttaagaagagaaagaaggtgctgtcctggccctttctcatgagaaggctctcccctgcatcagatttttctggggctttggagacagacttgaaagcatcgctatttgatcagcccttgtcaattatctgcggtgacagtgacacactccccagacccatccaggacattctcactattctatgccttaaaggcccttcaacggaagggatattcaggagagcagccaacgagaaagcccgtaaggagctgaaggaggagctcaactctggggatgcggtggatctggagaggctccccgtgcacctcctcgctgtggtctttaaggacttcctcagaagtatcccccggaagctactttcaagcgacctctttgaggagtggatgggtgctctggagatgcaggacgaggaggacagaatcgaggccctgaaacaggttgcagataagctcccccggcccaacctcctgctactcaagcacttggtctatgtgctgcacctcatcagcaagaactctgaggtgaacaggatggactccagcaatctggccatctgcattggacccaacatgctcaccctggagaatgaccagagcctgtcatttgaagcccagaaggacctgaacaacaaggtttgttctgcttactgatgagaaatccccaacttatgatctcaccatctgtttgccaagtccaggcaataaaatgcttcagaatgtctccaactgactcagaatcacagtgaaaatataaaatgcaaaatgcttttgtcatagttccactctctcagatacatgtatctaatgaaactgaataaatccgtgtcttctgtca

SEQ ID NO: 189756 - DNA, 3887 bp, Homo sapiens
  Payload ID: 17471
  Gene Symbol: TAGAP
  Gene Name: T-cell activation RhoGTPase activating protein
  Uniprot ID: Q8N103
  ENST ID: ENST00000367066
  CDS Start-End: 333-2528
gacatagctgccctaaaaggaatgaggaagcgagagctctccagtgtctggctggctccgtccgtgtgacagcccatgatgttctttccggtctctgtaatattctgaatttccacctgcccgccccttcgcttataatgcagagcatgtgaagggagaccggctcggtctctctctctcccagtggactagaaggagcagagagttatgctgtttctcccattctttacagctcaccggatgtaaaagaactctggctagagaccctccaaggacagaggcacagccacacgggagtgaaatccacccctggacagtcagccgcaatactgatgaagctgagaagcagccacaatgcttcaaaaacactaaacgccaataatatggagacactaatcgaatgtcaatcagagggtgatatcaaggaacatcccctgttggcatcatgtgagagtgaagacagtatttgccagctcattgaagttaagaagagaaagaaggtgctgtcctggccctttctcatgagaaggctctcccctgcatcagatttttctggggctttggagacagacttgaaagcatcgctatttgatcagcccttgtcaattatctgcggtgacagtgacacactccccagacccatccaggacattctcactattctatgccttaaaggcccttcaacggaagggatattcaggagagcagccaacgagaaagcccgtaaggagctgaaggaggagctcaactctggggatgcggtggatctggagaggctccccgtgcacctcctcgctgtggtctttaaggacttcctcagaagtatcccccggaagctactttcaagcgacctctttgaggagtggatgggtgctctggagatgcaggacgaggaggacagaatcgaggccctgaaacaggttgcagataagctcccccggcccaacctcctgctactcaagcacttggtctatgtgctgcacctcatcagcaagaactctgaggtgaacaggatggactccagcaatctggccatctgcattggacccaacatgctcaccctggagaatgaccagagcctgtcatttgaagcccagaaggacctgaacaacaaggtgaagacactggtggaattcctcattgataactgctttgaaatatttggggagaacattccagtgcattccagtatcacttctgatgactccctggagcacactgacagttcagatgtgtcgaccctgcagaatgactcagcctacgacagcaacgaccctgatgtggaatccaacagcagcagtggcatcagctctcccagcaggcagccccaggtgcccatggccacagctgctggcttggatagcgcgggcccacaggatgcccgagaggtcagcccagagcccattgtgagcaccgtggccaggctgaaaagctccctcgcacagcccgataggagatactcagagcccagcatgccatcctcccaggagtgcctcgagagccgggtgacaaaccaaacactaacaaagagtgaaggggacttccccgtgccccgggtaggctctcgtttggaaagtgaggaggctgaagacccatttccagaggaggtcttccctgcagtgcaaggcaaaaccaagaggccggtggacctgaagatcaagaacttggccccgggttcggtgctcccgcgggcactggttctcaaagccttctccagcagctcgctggacgcgtcctctgacagctcgcccgtggcttctccttccagtcccaaaagaaatttcttcagcagacatcagtctttcaccacaaagacagagaaaggcaagcccagccgagaaattaaaaagcactccatgtctttcacctttgcccctcacaaaaaagtgctgaccaaaaacctcagcgcgggctctgggaaatcgcaagactttaccagggaccacgtcccgaggggtgtcagaaaggaaagccagcttgccggccgaatcgtgcaggaaaatgggtgtgaaacccacaaccaaacagcccgcggcttctgcctgagaccccacgccctctcggtggatgatgtgttccagggagctgactgggagaggcctggaagcccaccctcttatgaagaggccatgcagggcccggcagccagactagtggcctccgagagccagaccgtggggagcatgacggtggggagcatgagggcgaggatgctggaggcgcactgcctcctaccccctcttccacctgctcaccacgtagaggactcaagacacaggggcagcaaagagccactccctggccacggactctctcccctgcctgagcgatggaaacagagcagaactgtccatgcttctggggactctctggggcacgtgtctggcccagggagacctgagctcctcccgctgaggaccgtctccgagtccgtgcagaggaataagcgggactgtctcgtgcgacgatgtagccagccggtctttgaggctgaccaattccaatatgccaaagaatcgtatatttaggagggaggccatacgccatgccatagcttgtgctatctgtaaatatgagacttgtaaagaactgcctgtagattgtttttaaaaggtcttgaataagctccttgagaaagttgtggaaagccctcctcagtgaggatagctacaccatggccatggcgcatcagatagtctctgtgtacctggatttgtgcaatatgtaaaaatgtatcaaatgtattatagataaggtgttaggtgcaaaggatgtctaataatccctgcacacgttttgaacttgcagtgaagtacactgctgttccttgcttcctggggcacttttctcttggttagtgtttaaaaattatcttcgcttttttaatgtggcctcaaatgtcatgccaattttcacatcttccacaaactccatttagggagaaatgtttaaatctctggtataagtttactccataccagagtaaactatatattactctatataagcagtcttgcaataactaatcaccaccatagaagaaagaaacagactgcaaggaacagagttgagtgtctggagtcatcaaaggcattaaaaactccagtaaaagctggggccgtagcaaaaatcatgaaaaacacttcaacgtgtcctttcaatcatccaattaaatgtgggtagattaatgaaaatgtattacatcaatattaactcatctatagcactttgagtatctttgtagttcatgatatcctatcctataatgtggaggtaaatgattttatatgcattgggggtcatatataaaacttcaatgtaatttcactacaataaattgccttccttatttgaaagtaaaaatgttctttttttattgacatgttaactcctttccctcaattaatagaaatccactaagaaaatcattcacatattggttcactcaacaagcatttattaaatatatattcactattctagactaatagcaagaccggggatcttgtttaggaagaagcagtccctgttctccagaatttgcaaaaccattaaaaaagcacctactttaagccattttttttcagcaaggagtcattctgccagaaaaatgtagtacacaaatacaggataatataacaaatgtaaaatttctcatttctagtgaattaaactttccagtaattttacatctcacctcattcttatgatgctcagtttgcttaattattggcaaacataatggtaaaatgtttgtactgtattagagctttactgttcgattattaagatatttatccagtatcttagagatgctggacttcaattttccttattttatctttttaaaataaaatatcatgcatgcttctgatttgttatagaaa

SEQ ID NO: 189757 - DNA, 5001 bp, Homo sapiens
  Payload ID: 17472
  Gene Symbol: TAL1
  Gene Name: T-cell acute lymphocytic leukemia 1
  Uniprot ID: P17542
  ENST ID: ENST00000294339
  CDS Start-End: 578-1573
gcccgggactatcccttcgcggtgtagcggcagccggagacctggctgaggaggcaaccgcgtagacacctccctgcttagaaaacaaacactgaaccagaccgatcccagttggagggttcgaaaatgttccagacagcctgtcgggaggggttgttgttgctgttggactaaatagctattcctgattggtcatgtatagggttttttaaggcgggtggggggaggagggggtagaggaaaggctccaaacacctgcaggttgggggcggaaagctgtttgcgattccctggactggttggtcggggacaggaggtaattcccagccattgacccccatttctctctctccctccctcttgccctgcctctttctctccacccctatctttcctggaaactcgctttgggcgcggcagatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccaggatgaccgagcggccgccgagcgaggcggctcgcagtgacccccagctagagggacgggacgcggccgaggccagcatggcccccccgcacctggtcctgctgaacggcgtcgccaaggagacgagccgcgcggccgcagcggagcccccagtcatcgaactgggcgcgcgcggaggcccggggggcggccctgccggtgggggcggcgccgcgagagacttaaagggccgcgacgcggcgacggccgaagcgcgccatcgggtgcccaccaccgagctgtgcagacctcccgggcccgccccggcccccgcgcccgcctcggttacagcggagctgcccggcgacggccgcatggtgcagctgagtcctcccgcgctggctgcccccgccgcccccggccgcgcgctgctctacagcctcagccagccgctggcctctctcggcagcgggttctttggggagccggatgccttccctatgttcaccaccaacaatcgagtgaagaggagaccttccccctatgagatggagattactgatggtccccacaccaaagttgtgcggcgtatcttcaccaacagccgggagcgatggcggcagcagaatgtgaacggggcctttgccgagctccgcaagctgatccccacacatcccccggacaagaagctcagcaagaatgagatcctccgcctggccatgaagtatatcaacttcttggccaagctgctcaatgaccaggaggaggagggcacccagcgggccaagactggcaaggaccctgtggtgggggctggtgggggtggaggtgggggagggggcggcgcgcccccagatgacctcctgcaagacgtgctttcccccaactccagctgcggcagctccctggatggggcagccagcccggacagctacacggaggagcccgcgcccaagcacacggcccgcagcctccatcctgccatgctgcctgccgccgatggagccggccctcggtgatgggtctgggccaccaggatcagccaggagggcgttcttaggctgctgggatggtgggcttcagggcaggtggggtgagaattgggcggctctgaagcaaggcggtggacttgaactttcctggatgtctgaactttgggaagcctttactgaccctggggctggcttttctgtttcctgtaccagtaggagatcagaaaaatggagcaaagtggtaggtactttttgtgaagacggcacggtcttccctcttccctcagtcccaaatccttcccaagtaagaggctggagttgtcactgcttttggcctggagtttgggatccctgtctttcctaagacctggggttgtcagctctcatctgaggcatccagcagtctctgccttgcctttagcccctcccaagctggctggggtggcctgtgtggccacttctgtccatatttataggtacccaatagctgcccatttcgtgagccccatcttcacccaggcctatgttgatccatccagcttgccagatgctgcagagtcacaagcctcgaggtgccttcttcagggcctggttgaagaagatgatcagtggacagtctgctctagatgagctgggccggagggtcaggaaacccagtcgcccttacttcttgccctggggatcaaagttctgctttctccccaatgagacttgccttcctaagcctgtggctgtggagacaatgtctgcagccctgagaaagccctgtcgggctttgtgtgaaggcagagaaagggacaatgatagtagagtgatatggagcaagagatattttgggcatgtgggcttcaactcctcgacatcactgttcatgctggcgagtgaatgccagtgtgctgatgggcgtacgctggtgctgagtagatgcgcagccccatctgtgcattctcctggatgcttagagggatttctttgctgtaagatgtctgtttgctgatggtctggtctatgttccgaattgagcacaaaacctgtcctatgaatgctttgcatttggaatttttgcttgacttcagttattggtggaatctttagcgctcaataggaccaggatccagcctcacttctagggtatgggaaatccaatcagagaccaggccctggctaagacccaaacatatgcacattcacttagcagaaccttaaacacccctcagttgtgcagcttttggtcatcaagggtgcgtctgggaggttggtttaatgcaatagaagtgctcccctctgaaagttgtacatgaaatttttgtaaatcacatccttatccttcatcttttaaagaaataaccactgcaagtccttttgtaaagtgaagaatccttttgtagaatgaaccactgccccttcattgatttcctgtgtcaatccagatggtgggatgtggttttcttaaggtgaggcctgtctgtgacctgcatctaagcccatgggacaaattgcacagaagtcctgtatgtctgtcattgtacccttaagtcaccctagccctctccctctaggctctgccttcgaggtcagaggagagatagcctgtggccctgtcctgccatgcaagaactcatcactgtggctgtctggaaagcccccccttatagtttgggcttcagcctagtggcttgtcctcaccatgatggggccctaattcagccatgtacagacagagaatatgtctgctcctttccccttccttttaagtaaggtccaattctcgagcttggggcaacattgttcacctttgtagcactcaggctctccattcaatttcaggctccccagatcatgttttggtgaaaattagggttggttcctttccaacgtttggaagatcctgtgaggagccccatctgtctaaagatagagtcattgctgtaggatctaaggctgtttgcttcaccgtggattcgcttgagttaggaatgagaagtagccacagtatggatgggtggatgggttttatgagatggatcacatattttattaagaactcaaacttctggctccctcttctttcagacttgccatgtgactctggcttggcctatctcctagggctatggtgtggactgaatgggatcatgaaagtagacagttttgagaacgtaaagaactttttcttttccctcaatctcaatcctgcagtggggtttcgcagcctgagtccacgacctaggcagtaggccggtgtgcctgactgcccagcatttgggtaatttagattgtaaaccgctttggcctgagttattgagattgtcctcatttctccagattatctatttgtgtgtgtgtgtgtgtgtgtgtgagagacggtgtcttgttctgtcactcaggctggagtacagtggtgccatcattgctgtctgcagccttgaactctgggctcaagcaatcctctcacctcagcctcccgagtagggaggaccacaggtgtgagccaccacacctggctaatttttacttttttttttttttggtagagatggagtcttgctatattgcccaggctggtcttgaagtcctggcttcaggcaattctcctgcctttgcctccagaagcactgggatcacaggtgtcagccattgcacccagcccagattgtcttaatttctatcttgttccaaggccagggacagtaataagaatggaaaagagatatgggaacactggcagactgtgtaaaatgtaatgcaactacccaaaacaagcctggtaggaaagggcaagtctttaggtctttgtaagaactaaagaagatctgtaatttttattttcaccctctgtaccccatgaccttatccttcctctccttccttgttacccatgaaaaactggcaacattccaagaatagcatctgtacaaaggggaaagaacataaaggtaaaacaaaacaaaacaacattttgagaacaaagatgaccataaccactgaagggaatcacatcttttaagacaaattcatattcttttatttgttatggcagatgacaagatggtacaacctttattcttttccaaaataaaacaaagggcacagcatctgtagtcagccgacaactatttcggccttttgggggtgggtctggccgtacttgtgatttcgatggtacgtgaccctctgctgaagacttgccccctgcccgtgtacatagtgcattgtttctgtgggcgggcccagcactttccgtcaacgttgtactgtatgtgatgaattgcgttggtctctgcatttttctgcagaagaggagtaaccgctccaggtaccttgacctttgtacagcccagaggccaacactgtgggtgtgtgactctttagcaaaaaaaacccatgtggtgatgatgtgtatatatatgtgaggatgtatcgggaagatttctaaataaaagttttacaaaggg

SEQ ID NO: 189758 - DNA, 4642 bp, Homo sapiens
  Payload ID: 17472
  Gene Symbol: TAL1
  Gene Name: T-cell acute lymphocytic leukemia 1
  Uniprot ID: P17542
  ENST ID: ENST00000371884
  CDS Start-End: 217-1212
cgttttcttcgttgcgtacgattgtgctccgttggtgttctcagcagggatctgattctatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccaggatgaccgagcggccgccgagcgaggcggctcgcagtgacccccagctagagggacgggacgcggccgaggccagcatggcccccccgcacctggtcctgctgaacggcgtcgccaaggagacgagccgcgcggccgcagcggagcccccagtcatcgaactgggcgcgcgcggaggcccggggggcggccctgccggtgggggcggcgccgcgagagacttaaagggccgcgacgcggcgacggccgaagcgcgccatcgggtgcccaccaccgagctgtgcagacctcccgggcccgccccggcccccgcgcccgcctcggttacagcggagctgcccggcgacggccgcatggtgcagctgagtcctcccgcgctggctgcccccgccgcccccggccgcgcgctgctctacagcctcagccagccgctggcctctctcggcagcgggttctttggggagccggatgccttccctatgttcaccaccaacaatcgagtgaagaggagaccttccccctatgagatggagattactgatggtccccacaccaaagttgtgcggcgtatcttcaccaacagccgggagcgatggcggcagcagaatgtgaacggggcctttgccgagctccgcaagctgatccccacacatcccccggacaagaagctcagcaagaatgagatcctccgcctggccatgaagtatatcaacttcttggccaagctgctcaatgaccaggaggaggagggcacccagcgggccaagactggcaaggaccctgtggtgggggctggtgggggtggaggtgggggagggggcggcgcgcccccagatgacctcctgcaagacgtgctttcccccaactccagctgcggcagctccctggatggggcagccagcccggacagctacacggaggagcccgcgcccaagcacacggcccgcagcctccatcctgccatgctgcctgccgccgatggagccggccctcggtgatgggtctgggccaccaggatcagccaggagggcgttcttaggctgctgggatggtgggcttcagggcaggtggggtgagaattgggcggctctgaagcaaggcggtggacttgaactttcctggatgtctgaactttgggaagcctttactgaccctggggctggcttttctgtttcctgtaccagtaggagatcagaaaaatggagcaaagtggtaggtactttttgtgaagacggcacggtcttccctcttccctcagtcccaaatccttcccaagtaagaggctggagttgtcactgcttttggcctggagtttgggatccctgtctttcctaagacctggggttgtcagctctcatctgaggcatccagcagtctctgccttgcctttagcccctcccaagctggctggggtggcctgtgtggccacttctgtccatatttataggtacccaatagctgcccatttcgtgagccccatcttcacccaggcctatgttgatccatccagcttgccagatgctgcagagtcacaagcctcgaggtgccttcttcagggcctggttgaagaagatgatcagtggacagtctgctctagatgagctgggccggagggtcaggaaacccagtcgcccttacttcttgccctggggatcaaagttctgctttctccccaatgagacttgccttcctaagcctgtggctgtggagacaatgtctgcagccctgagaaagccctgtcgggctttgtgtgaaggcagagaaagggacaatgatagtagagtgatatggagcaagagatattttgggcatgtgggcttcaactcctcgacatcactgttcatgctggcgagtgaatgccagtgtgctgatgggcgtacgctggtgctgagtagatgcgcagccccatctgtgcattctcctggatgcttagagggatttctttgctgtaagatgtctgtttgctgatggtctggtctatgttccgaattgagcacaaaacctgtcctatgaatgctttgcatttggaatttttgcttgacttcagttattggtggaatctttagcgctcaataggaccaggatccagcctcacttctagggtatgggaaatccaatcagagaccaggccctggctaagacccaaacatatgcacattcacttagcagaaccttaaacacccctcagttgtgcagcttttggtcatcaagggtgcgtctgggaggttggtttaatgcaatagaagtgctcccctctgaaagttgtacatgaaatttttgtaaatcacatccttatccttcatcttttaaagaaataaccactgcaagtccttttgtaaagtgaagaatccttttgtagaatgaaccactgccccttcattgatttcctgtgtcaatccagatggtgggatgtggttttcttaaggtgaggcctgtctgtgacctgcatctaagcccatgggacaaattgcacagaagtcctgtatgtctgtcattgtacccttaagtcaccctagccctctccctctaggctctgccttcgaggtcagaggagagatagcctgtggccctgtcctgccatgcaagaactcatcactgtggctgtctggaaagcccccccttatagtttgggcttcagcctagtggcttgtcctcaccatgatggggccctaattcagccatgtacagacagagaatatgtctgctcctttccccttccttttaagtaaggtccaattctcgagcttggggcaacattgttcacctttgtagcactcaggctctccattcaatttcaggctccccagatcatgttttggtgaaaattagggttggttcctttccaacgtttggaagatcctgtgaggagccccatctgtctaaagatagagtcattgctgtaggatctaaggctgtttgcttcaccgtggattcgcttgagttaggaatgagaagtagccacagtatggatgggtggatgggttttatgagatggatcacatattttattaagaactcaaacttctggctccctcttctttcagacttgccatgtgactctggcttggcctatctcctagggctatggtgtggactgaatgggatcatgaaagtagacagttttgagaacgtaaagaactttttcttttccctcaatctcaatcctgcagtggggtttcgcagcctgagtccacgacctaggcagtaggccggtgtgcctgactgcccagcatttgggtaatttagattgtaaaccgctttggcctgagttattgagattgtcctcatttctccagattatctatttgtgtgtgtgtgtgtgtgtgtgtgagagacggtgtcttgttctgtcactcaggctggagtacagtggtgccatcattgctgtctgcagccttgaactctgggctcaagcaatcctctcacctcagcctcccgagtagggaggaccacaggtgtgagccaccacacctggctaatttttacttttttttttttttggtagagatggagtcttgctatattgcccaggctggtcttgaagtcctggcttcaggcaattctcctgcctttgcctccagaagcactgggatcacaggtgtcagccattgcacccagcccagattgtcttaatttctatcttgttccaaggccagggacagtaataagaatggaaaagagatatgggaacactggcagactgtgtaaaatgtaatgcaactacccaaaacaagcctggtaggaaagggcaagtctttaggtctttgtaagaactaaagaagatctgtaatttttattttcaccctctgtaccccatgaccttatccttcctctccttccttgttacccatgaaaaactggcaacattccaagaatagcatctgtacaaaggggaaagaacataaaggtaaaacaaaacaaaacaacattttgagaacaaagatgaccataaccactgaagggaatcacatcttttaagacaaattcatattcttttatttgttatggcagatgacaagatggtacaacctttattcttttccaaaataaaacaaagggcacagcatctgtagtcagccgacaactatttcggccttttgggggtgggtctggccgtacttgtgatttcgatggtacgtgaccctctgctgaagacttgccccctgcccgtgtacatagtgcattgtttctgtgggcgggcccagcactttccgtcaacgttgtactgtatgtgatgaattgcgttggtctctgcatttttctgcagaagaggagtaaccgctccaggtaccttgacctttgtacagcccagaggccaacactgtgggtgtgtgactctttagcaaaaaaaacccatgtggtgatgatgtgtatatatatgtgaggatgtatcgggaagatttctaaataaaagttttacaaaggggc

SEQ ID NO: 189759 - DNA, 656 bp, Homo sapiens
  Payload ID: 17473
  Gene Symbol: TAL2
  Gene Name: T-cell acute lymphocytic leukemia 2
  Uniprot ID: Q16559
  ENST ID: ENST00000334077
  CDS Start-End: 41-367
ccctgagggccctttctctttccatctcaggaactcaaacatgaccaggaagatcttcacaaataccagggagcggtggaggcagcagaatgtcaacagcgcctttgccaagctgaggaagctcatccccactcaccctccagacaaaaagctgagcaaaaatgaaacgcttcgcctggcaatgaggtatatcaacttcttggtcaaggtcttgggggagcaaagcctgcaacaaacgggagtggctgctcaggggaacattctggggctcttccctcaaggaccccacctgccaggcctggaggacagaactctgcttgagaactaccaggttccttcacctggtccaagccaccacattccttagtgtggctctggctgtcatctcccagggcagcacttgcccagaaatcactgcctgtggacagacttttgcatgttccagagttgacctgatgataactcgtgaagcatgaattctagcttcctgggaggtggctcagagacagctgcagggagctgaaagaagccatgaggaatgtcacttgtgggccgccaccccccagggatgtcaggtagagcggcctacctctgcctattttaaatccaggttctgcataagacttttggagaaaaaattctaaataaaaaaaaaa

SEQ ID NO: 189760 - DNA, 1369 bp, Homo sapiens
  Payload ID: 17474
  Gene Symbol: TIMD4
  Gene Name: T-cell immunoglobulin and mucin domain containing 4
  Uniprot ID: Q96H15
  ENST ID: ENST00000274532
  CDS Start-End: 58-1194
ataagaggttgggctttggatagatagacagactcctgggtccggtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgttgagtctacttctgctgacactgtcctgctgacatccaaagagtccaaagtttgggatctcccatcaacatcccacgtgtcaatgtggaaaacgagtgattctgtgtcttctcctcagcctggagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtagatttccttgtttcataaaaaagactcacttattccatggatgtcattgatccaggcttgctttagtttcatgaatgaagggtactttagagaccacaacttctctgtc

SEQ ID NO: 189761 - DNA, 581 bp, Homo sapiens
  Payload ID: 17474
  Gene Symbol: TIMD4
  Gene Name: T-cell immunoglobulin and mucin domain containing 4
  ENST ID: ENST00000406964
  CDS Start-End: 237-479
gtgttctagaatccctggtttccttctatctacctaatctgcgtgaaatgtgacagtatctcaccatttctttctctttctgaaccacattgggtgccaacagaacttgctctctgttctctttcaaaattaccaacatggaccccacccaattcttcccttggaactaaggaacgcctgactgatcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtagatttccttgtttcataaaaaagactcacttattcc

SEQ ID NO: 189762 - DNA, 1145 bp, Homo sapiens
  Payload ID: 17474
  Gene Symbol: TIMD4
  Gene Name: T-cell immunoglobulin and mucin domain containing 4
  Uniprot ID: Q96H15
  ENST ID: ENST00000407087
  CDS Start-End: 25-1077
tcctgggtccggtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgttgagtctacttctgctgacactgtcctgctgacatccaaagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtaga

SEQ ID NO: 189763 - DNA, 2906 bp, Homo sapiens
  Payload ID: 17475
  Gene Symbol: TLX1
  Gene Name: T-cell leukemia homeobox 1
  Uniprot ID: P31314
  ENST ID: ENST00000370196
  CDS Start-End: 1038-2030
cctctttcgaaccctgtaggattttacttcttgacgcatctgtttatttaaaaccaaaggggtatgttgaggcatgggcaccctggcagcagaccccaaaccaaccctcttgacttgtgcctgcctttcaggatatgttcccttcctgaatttgtctaagaaggctgagttggggggtggttgctgatttttataacatatagccagttgttcataggcctgtgttttaaagaagggcaagcctgaactcaccgtcctgcctcagggcctgggctccatacctggggagtagacagtcttctactttctaaaaagctggacttgaaatttggagtaaatctcctggttgagtgacaggtgtttcgcagctgagcccttgaggagattctccagttgggcagagacatcccttcctcagacgccttgtgggctggactcctttggcccagttcaaagtgaggggagggctcccaacaggccgggaagacagttgacttcaccctccttgggtttgtctgtctgtccgtctctgggaatggtcgcttcctgttttcccttttccttttaagcctcgccttgttcccctcttctctctcttcatgaactactccgagtcttggtctccgtccctctatctctggctcctgcatctgtctcggcttctggccttcctctccccctcccctcccctccctcgcgctgtcattcaccccgctcctctccgcgcacagccaatggagagacccagtcgaaaccgcgaagctctcttgcaccgggctttttcgcctggtgattgatgtcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtcacccctatcagaaccggacgccccccaagaagaagaagccgcgcacgtccttcacacgcctgcagatctgcgagctggagaagcgcttccaccgccagaagtacctggcctcggccgagcgcgccgccctggccaaggcgctcaaaatgaccgatgcgcaggtcaaaacctggttccagaaccggcggacaaagtggagacggcagactgcggaggaacgggaggccgagaggcagcaagcgaaccgcatcctcctgcagttgcagcaggaggccttccagaagagcctggcacagccgctgcccgctgaccctctgtgcgtgcacaactcgtcgctcttcgccctgcagaatctgcagccgtggtctgacgactcgaccaaaatcactagcgtcacgtcggtggcgtcggcctgcgagtgagcctgcccattctgccctgtgggaccccaggcccactcaggggtcactgaggcctgagacccaggactcctccccaccctcctggcctcagactgcacccaggaggggaacactgccctcgcacggccccgaagggcccccacatttgtgccgacactgttctcccttcggtggaagagctcaagggacaaggacacgcgcccccctcccagaggcgtcccgcacctgtctgaactgttaagaaatctgtttttgtttatttcattttattttaatttttaacgtgggattcagagaaaggcaagggaggtaagggaggaggagcttctggggtccccagggctgtcatctgaatttgccctgggaaaccccttctctgtgacccacttctcatcacacacatggaaacccataggcccacacacaggtggtgtcactgtccctcctggtgtcaccccagagccacacatgggcatctatgggagagtgtcaaccagacagagggtcacagtgtttacactttggaccttacgatcaggcacaggtcaggggtgacacagactcatcctgaacagcatggcactccctccagcacaaacacaaggtcatggccacactgtgacacactacaccacacacaacagccaacagctacaacagcctcacttggtctgccaggcccccaccacacatcccagcccaatccaggtacgcacagacaggttttcacataaatgcagcccatttctccagaacccatttgaggggtgggggggtgttaatttatgcacttataaggtgttttctgtgtaaccattttataaagtgcttgtgtaatttatgtgaaaaaaataaataaaagcctccggatccgga

SEQ ID NO: 189764 - DNA, 469 bp, Homo sapiens
  Payload ID: 17475
  Gene Symbol: TLX1
  Gene Name: T-cell leukemia homeobox 1
  ENST ID: ENST00000463716
  CDS Start-End: 1-469
gcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacagtggccctctcacccttcactgtaacacgccgtataggtcacccctatcagaaccggacgccccccaagaagaagaagccgcgcacgt

SEQ ID NO: 189765 - DNA, 1838 bp, Homo sapiens
  Payload ID: 17475
  Gene Symbol: TLX1
  Gene Name: T-cell leukemia homeobox 1
  Uniprot ID: P31314
  ENST ID: ENST00000467928
  CDS Start-End: 239-1012
tcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtcacccctatcagaaccggacgccccccaagaagaagaagccgcgcacgtccttcacacgcctgcagatctgcgagctggagaagcgcttccaccgccagaagtacctggcctcggccgagcgcgccgccctggccaaggcgctcaaaatgaccgatgcgcaggtcaaaacctggttccagaaccggcggacaaagtggaggtaacggcttgttcccggtgcagacggcagactgcggaggaacgggaggccgagaggcagcaagcgaaccgcatcctcctgcagttgcagcaggaggccttccagaagagcctggcacagccgctgcccgctgaccctctgtgcgtgcacaactcgtcgctcttcgccctgcagaatctgcagccgtggtctgacgactcgaccaaaatcactagcgtcacgtcggtggcgtcggcctgcgagtgagcctgcccattctgccctgtgggaccccaggcccactcaggggtcactgaggcctgagacccaggactcctccccaccctcctggcctcagactgcacccaggaggggaacactgccctcgcacggccccgaagggcccccacatttgtgccgacactgttctcccttcggtggaagagctcaagggacaaggacacgcgcccccctcccagaggcgtcccgcacctgtctgaactgttaagaaatctgtttttgtttatttcattttattttaatttttaacgtgggattcagagaaaggcaagggaggtaagggaggaggagcttctggggtccccagggctgtcatctgaatttgccctgggaaaccccttctctgtgacccacttctcatcacacacatggaaacccataggcccacacacaggtggtgtcactgtccctcctggtgtcaccccagagccacacatgggcatctatgggagagtgtcaaccagacagagggtcacagtgtttacactttggaccttacgatcaggcacaggtcaggggtgacacagactcatcctgaacagcatggcact

SEQ ID NO: 189766 - DNA, 2136 bp, Homo sapiens
  Payload ID: 17476
  Gene Symbol: TLX2
  Gene Name: T-cell leukemia homeobox 2
  Uniprot ID: O43763
  ENST ID: ENST00000233638
  CDS Start-End: 324-1178
ccacccgggacttgggcagcggcgccggcagcccagcgtctatttgcgcttaagagccagcaaggaagctccaggggccccagctggccgtgctcccccgggatgcaagtccctgcgctgacgcccggcagcggctggcacgggcgcggctgctccgggtgcacagggatgctgctgtttcggggaccccggcgccctgccttggccagccccgcgggcccctgaggccactctccggagcgcgccgccgctgggcttctggcgctgcctgaggcatcctccccaaccaccgaacctccggcggttctcctcggcccagaccgatggagccggggatgctgggtccacacaacctcccacaccacgagccaatcagcttcggcatcgatcagatcctgagcggccccgaaaccccagggggcggtctaggcctgggtcgcgggggccagggtcatggggagaatggggcgttctcgggtggataccacggagcctcgggctacggtcccgccggctcacttgccccgctgcccggcagctccggagtgggcccaggcggcgtgatccgcgtccctgcgcaccgcccgctgcctgtgccgccgcccgctgggggggcgcctgcagtgcctgggccctcgggtttgggcggcgccggaggcctagcgggactcaccttcccctggatggacagcggccgccgctttgccaaggaccggctcacggctgcgctctcgcccttctctgggacgcgccgcataggccacccctaccaaaaccggacccctccgaagcggaagaagccgcgcacgtccttctcccgctcacaggtgctggagttggagcggcgcttcctgcgccagaagtacctggcctctgcggagagggcggcgctggccaaggccttgcgcatgaccgacgcacaggtcaaaacgtggttccagaaccgacgcaccaagtggcggcgccagacggcggaggagcgcgaggccgagcggcaccgcgcgggccggctgctcctgcatctgcagcaggacgcgttgccacggccgctgcggccgccgctgcccccggaccctctctgcctgcacaactcgtcgctcttcgcgctgcagaacctgcagccctgggccgaggacaacaaagtggcttcagtgtccgggctcgcctcggtggtgtgagcgacgcccgtccgatcggcgtggagcgccgggcccggagcggtggagcgcgcggctgcctgcgtccatggtctagtggcagccgggcgcgtgaggagcggcaggccttgaggctgtcgtcgagggctcctccaccaccggccggctcccaagccagcgttgcgcagatgcacggccagctcagaggcggcctttcccgccatttttcacttcactgccgttacgccctcgctggaacctgaggcgccgagagggcgggacctgcaggacagtagccaatgaggtgcggggagggggccgggctggccaatgggagctgctttcctgagggactcgaaattctccggcgggtggtcgggagctggggctctgaggggctctagcggcgttgcgcgcggtgccggctgggtctgtaccaaaggtgtgaaggaaagaagacaccgaccacggcgaagcaatagagggggtgctggagcgcgagaggctggctgattgtgaccgaaaccagagggttgtccaccccgggcatctcatccctcaactgtaaaataatcgctaaggattccttcctgactttgagcctcacgttgtcatgtgtgttcagcctgctggccacatcctccggcaacacgcccgggcaggaggcgagtcggatacttacacacccaacgaaagagaaaatctggctccggtgtcacatagggacagagaagggagaggaggaaacagtggacaaagttaatgggcccagtggagttagggtgaagagaatttggaaaataatttggaagtgacaagcttaagaagaatcaaaggtaattccaagactggaaatgtgcagcatcaggaaatcaatggtgctgtggatgatgaaagggaaattgggaagactggagcaaaattaactgtataggcaaaactaaatgttatacctagagagaataaatcctggagaagt

SEQ ID NO: 189767 - DNA, 1452 bp, Homo sapiens
  Payload ID: 17476
  Gene Symbol: TLX2
  Gene Name: T-cell leukemia homeobox 2
  ENST ID: ENST00000621092
  CDS Start-End: 415-1122
gtaaaatgtttatgggaaacaaggcggccaggatccaaccaaggcctcagtgaggtcccacgtgtcccccgtggcgagatttcgccctcccgccgttgaggaggaagagtgtgagaacagacttcctaggcacagaatggaggggcagagtcctgcattgaggactccctgcacttggggtccggggctcaccgggcgccgttccccagccgcttcttacgcagccgggaaaccacaacgagatttggtcttcgagagcatttaggcggggaccacaacgaatccgggagttggccagaaggatccatcgagaggcgaagagtgggggctgggggaggaggcacctgcggaggaagccggtgaggcggaggcagcccaaaggcggaggccgcccaaaggcggaggccagcaaggatggaggcgcgctgcgctctcgcccttctctgggacgcgccgcataggccacccctaccaaaaccggacccctccgaagcggaagaagccgcgcacgtccttctcccgctcacaggtgctggagttggagcggcgcttcctgcgccagaagtacctggcctctgcggagagggcggcgctggccaaggccttgcgcatgaccgacgcacaggtcaaaacgtggttccagaaccgacgcaccaagtggcggcgccagacggcggaggagcgcgaggccgagcggcaccgcgcgggccggctgctcctgcatctgcagcaggacgcgttgccacggccgctgcggccgccgctgcccccggaccctctctgcctgcacaactcgtcgctcttcgcgctgcagaacctgcagccctgggccgaggacaacaaagtggcttcagtgtccgggctcgcctcggtggtgtgagcgacgcccgtccgatcggcgtggagcgccgggcccggagcggtggagcgcgcggctgcctgcgtccatggtctagtggcagccgggcgcgtgaggagcggcaggccttgaggctgtcgtcgagggctcctccaccaccggccggctcccaagccagcgttgcgcagatgcacggccagctcagaggcggcctttcccgccatttttcacttcactgccgttacgccctcgctggaacctgaggcgccgagagggcgggacctgcaggacagtagccaatgaggtgcggggagggggccgggctggccaatgggagctgctttcctgagggactcgaaattctccggcgggtggtcgggagctggggctctgaggggctctagcggcgttgcgcgcggtgccggctgggtctgtaccaaaggtgtgaaggaaagaagacaccgaccacggcgaagcaatagagggggtgctggagcgcgagaggctggctgattgtgaccgaaaccagagggttgtccaccccgggcatctcatccctcaactgtaaaataatcgctaaggattccttcctg

SEQ ID NO: 189768 - DNA, 1493 bp, Homo sapiens
  Payload ID: 17477
  Gene Symbol: TLX3
  Gene Name: T-cell leukemia homeobox 3
  Uniprot ID: O43711
  ENST ID: ENST00000296921
  CDS Start-End: 83-958
gccgggcgctccatggccgcgccgtaacggggacccagccgcctccccgcccagcccagcccagcccttccgcccgcccaggatggaggcgcccgccagcgcgcagaccccgcacccgcacgagcccatcagcttcggcatcgaccagatccttaacagcccggaccaggacagcgcacccgccccgcggggccccgacggcgccagctacctgggagggccccccgggggccgtccgggcgccacatacccgtctctgcccgcctcctttgcgggcctcggcgcgcccttcgaggacgcgggatcttacagtgtgaacctgagcctagcgcccgcaggcgtgatccgggtgccggcgcacaggccgctgcccggggccgtgccaccgcctctgccaagcgcgctacccgccatgccctccgtgcccacggtctccagccttggcggtctcaatttcccctggatggagagcagccgccgcttcgtgaaagaccgcttcacagcggcggccgcactcacgcccttcaccgtgacccggcgcatcggccacccctaccagaaccggacgccgcccaagcgtaagaagccgcgcacgtccttttcccgggtgcagatctgcgagctggaaaagcgcttccatcgccagaagtacctggcctctgccgagagggcggcgctcgccaagtccctcaaaatgacggacgcgcaggtcaagacctggttccaaaaccggaggaccaagtggcggcggcagacggcggaggagcgggaggcggagcggcagcaggcgagccggctcatgctgcagctgcaacacgacgccttccaaaagagcctcaacgactccatccagcctgacccgctctgtctgcacaactcgtcactctttgctctgcagaatctgcagccctgggaggaggatagttccaaggttcccgctgtcacctccctggtgtgagcccaccagcgcgcaccgtcgccacggatcgccgcccccacccagccgggcgccccggaccccccaggcgggctgcgggggaaccggcgccgagaggggaaggggccgcctagcccgagtaggccccagggcgcggccacagactggcgggccgcggaagggggtagggcccgagctccgcgcggccgcacaatccgagcccccgccccgcgccccgtcccgccccaggcccgggcctgacaagaaagcgccttacgtttctccgccccccgcccgcaccccccgggccgggcgcctgtattatactttgtacttttgcccaaacgtgtaaataataaaaaagttttggcttttttctttagaaaccggccacctgcttcccccgcgggggccgctggaggaagggcagccgacccggccgctgggggaagtgccaggggcccggggcaccctgcgtttaggctgggtccactcttcttcttttccgttccttttatttaagtctttttatttaataaaaaagttagctatttca

SEQ ID NO: 189769 - DNA, 2146 bp, Homo sapiens
  Payload ID: 17478
  Gene Symbol: TCTA
  Gene Name: T-cell leukemia translocation altered
  Uniprot ID: P57738
  ENST ID: ENST00000273590
  CDS Start-End: 222-533
tactcccggagtcactcatcccttaagcaagcagggtggggttaggtgcgcgtgcgcggttttaatactcctccccgaactgccaactcttcacgcacgcgaagtaggccccaccctggctgggtttacgcgtgcgcactaacgggcctggtcccggaagaccacacgcgtgcgtggtggggactacggtgacagtaccccgggtggggcgagggccagtcatggcggagtcctggtctgggcaggccttgcaggctctgccggccacggtgctgggcgcgctgggcagcgagttcttgcgggagtgggaggcgcaggacatgcgcgtgaccctcttcaagctgctgctgctgtggttggtgttaagtctcctgggcatccagctggcgtgggggttctacgggaatacagtgaccgggttgtatcaccgtccaggtctgggtggtcagaatggatccacgcctgatggctccacgcatttcccttcgtgggaaatggcagcaaacgaacctctcaaaacccacagagaataagggaaggcagcagagggtctccaagggcatcactgggtctgctggcttctacactgggttctgctactccccagacctcagggacaactgccgggggttcagggttggtagcagggagtacccagtgcctacagggctgggcctcttctgcctcttaagcctgctccctcacccaggcactgggcaagtgaagagtttgcctgtactcttatctgggtgccttaaggagagagattgtgttcttcctctctcaggggtgataactcaggaagcctctgggttgggaagaccatcagttcttttgtcttaggtttcttttcctgtccctcttccatccccaagatgtgaccccataaaaatttttcctgagttggccaggcatggtggctcacgcctgtaatcccaacactttgggaggctgaggcaggcagatcacgaggtcaggagttcgagaccagcctgaccaacatggtgaaaaccccatctctactaaaaatacaaaaattagccgggtgtggtggcacacaccagtaatcccagctactcaggaggctgaagcaggagatttgcttgaacctgggaggcagaggttgcagtgagccaagattgcgccgttgtactccagcctgggcaacagagcaagacccatctcaaaaaaaaaatttttttcctgagaggaagcctgaggttgaccagctctggggtttgtaaggcaggtctgttttctcctaggccctgagttttctgaatctctggttttgctttgttggcaaggagccagggaatcctgacctgagccagaccttaagctctatggttatttagctggccattcaggtataaggcagggtggtgtacctgctggcactatccagatggaggcaccaaacacccacatacctggcccaaccagacttctcccgtgagccaggcaaaggaaattgtcatctgccaactgtcctactcatattcctctcagtccttcttgggggtaagctgattacctgaaggacagctgaacccctggggtagcctcctatccaccactgcttaagtgcctatgggaatgtgggtctgcaccttgtcccctcataggatggtaccaagcatttagtgcacagtggccccatcatagcctgcagcctcatcatttcccatctggacctggtacaaatgcacgtcacaggctcagctcctccccactagcattttctctaccttcaagaaccaggcagccctgccatgtcacaataggccaggggagtttccaaagatgtgggtggcaaatgcccctatagaaacaccagtacctgaaagcactgtagccctggacctgcctccttccctcggggccatacttctgtttccatctgctgggccaccagccactttagtgacccctgcctacttccttcctgttggatatcatacttccatctggctgcctttgcttaagccatctttgtggtagaggggccctggaattgcagctgtactgaggatgatgttattcacagcccctggcccacccactaatactactgcacagagtcaggatctcacatttcaccccaggctcaactgaggatgtggcttattaaacacggaagtgc

SEQ ID NO: 189770 - DNA, 1395 bp, Homo sapiens
  Payload ID: 17479
  Gene Symbol: TCL1A
  Gene Name: T-cell leukemia/lymphoma 1A
  Uniprot ID: P56279
  ENST ID: ENST00000402399
  CDS Start-End: 131-475
gtcctcccgccccgccgcttggtggcggccgcatgctgcccggatataaagggtcggccccacatcccagggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatctaacttcgtgcggaatcagcttctatccttgacttagattctggtggagagaagtgagaataggcagcccccaaataaaaaatattcatgg

SEQ ID NO: 189771 - DNA, 717 bp, Homo sapiens
  Payload ID: 17479
  Gene Symbol: TCL1A
  Gene Name: T-cell leukemia/lymphoma 1A
  Uniprot ID: P56279
  ENST ID: ENST00000555202
  CDS Start-End: 65-409
ccagggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtgagctccactggagcctgacccctcttagtccacagtggctgtatcagaaagaaagaccaccccttctccatgaaggcagtgctaacccctccccgactgctgccatctgagggtccctagggatgggagaggcttcctggaggcactcatgtctcccttaccacttcgggagccaagggctttgtaggcagccccctttatcgcagctgctcatatctataaagtacttcacaagtttcagctggcactttcatttaccattgcttttttttttttttgagatgagtctggctctgtgg

SEQ ID NO: 189772 - DNA, 872 bp, Homo sapiens
  Payload ID: 17479
  Gene Symbol: TCL1A
  Gene Name: T-cell leukemia/lymphoma 1A
  Uniprot ID: P56279
  ENST ID: ENST00000556450
  CDS Start-End: 33-377
ggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatctaa

SEQ ID NO: 189773 - DNA, 913 bp, Homo sapiens
  Payload ID: 17479
  Gene Symbol: TCL1A
  Gene Name: T-cell leukemia/lymphoma 1A
  ENST ID: ENST00000554119
  CDS Start-End: 24-164
ttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagatacagggtctcgctctgtgacccaggctggtcttaaactcctggcctcaagcgatcctcctgcctctgccttccaaagcactggaattacaagtgtgagccgctgcaacccgccagaaaaaagtgtgcctttcatggccctgtctgggtggctagacacgtgtgtgtgctggtggtcctggcccagccagagtccctgagaggagcatgcatggcctaaggaagtgagcttcagggaacagtgatgaccatcatttcacactcggacccctgcccagatgggtggatggctggcaggagggattccggttttctgcgcctggagaagccctggcaagcggaacctgaaagtatgccctgtccttttcttctcctcagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaaggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctg

SEQ ID NO: 189774 - DNA, 882 bp, Homo sapiens
  Payload ID: 17479
  Gene Symbol: TCL1A
  Gene Name: T-cell leukemia/lymphoma 1A
  ENST ID: ENST00000556156
  CDS Start-End: 39-179
ggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagatacagggtctcgctctgtgacccaggctggtcttaaactcctggcctcaagcgatcctcctgcctctgccttccaaagcactggaattacaagtgtgagccgctgcaacccgccagaaaaaagtgtgcctttcatggccctgtctgggtggctagacacgtgtgtgtgctggtggtcctggcccagccagagtccctgagaggagcatgcatggcctaaggaagtgagcttcagggaacagtgatgaccatcatttcacactcggacccctgcccagatgggtggatggctggcaggagggattccggttttctgcgcctggagaagccctggcaagcggaacctgaaagtatgccctgtccttttcttctcctcagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgc

SEQ ID NO: 189775 - DNA, 1391 bp, Homo sapiens
  Payload ID: 17479
  Gene Symbol: TCL1A
  Gene Name: T-cell leukemia/lymphoma 1A
  Uniprot ID: P56279
  ENST ID: ENST00000554012
  CDS Start-End: 131-475
gtcctcccgccccgccgcttggtggcggccgcatgctgcccggatataaagggtcggccccacatcccagggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatctaacttcgtgcggaatcagcttctatccttgacttagattctggtggagagaagtgagaataggcagcccccaaataaaaaatattcatgga

SEQ ID NO: 189776 - DNA, 813 bp, Homo sapiens
  Payload ID: 17479
  Gene Symbol: TCL1A
  Gene Name: T-cell leukemia/lymphoma 1A
  ENST ID: ENST00000555886
  CDS Start-End: 62-202
gggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagatacagggtctcgctctgtgacccaggctggtcttaaactcctggcctcaagcgatcctcctgcctctgccttccaaagcactggaattacaagtgtgagccgctgcaacccgccagaaaaaagtgtgcctttcatggccctgtctgggtggctagacacgtgtgtgtgctggtggtcctggcccagccagagtccctgagaggagcatgcatggcctaaggaaataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcc

SEQ ID NO: 189777 - DNA, 980 bp, Homo sapiens
  Payload ID: 17479
  Gene Symbol: TCL1A
  Gene Name: T-cell leukemia/lymphoma 1A
  ENST ID: ENST00000557043
  CDS Start-End: 107-268
cgatcctcctgcctctgccttccaaagcactggaattacaagtataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaa

SEQ ID NO: 189778 - DNA, 1166 bp, Homo sapiens
  Payload ID: 17480
  Gene Symbol: TCL1B
  Gene Name: T-cell leukemia/lymphoma 1B
  Uniprot ID: O95988
  ENST ID: ENST00000340722
  CDS Start-End: 52-438
tggaaagctacacgtgtgagcctagaggcgggtcccggttgcagacttgccatggcctccgaagcttctgtgcgtctaggggtgccccctggccgtctgtggatccagaggcctggcatctacgaagatgaggaggggagaacctgggtgactgtggtcgtgcggttcaatccctcgcgtagggaatgggccagggcctcccagggcagcagatatgaacccagcatcacagtgcacttgtggcagatggcagtgcatacccgggagctactctcctccggccagatgcccttctcccagctgcccgccgtgtggcagctctaccccgggaggaagtaccgagcagcggattccagtttctgggaaatagcagaccatggccagattgactctatggagcagctggtcctaacatatcagccggagaggaaagactgacactgggagtggctggccctgctggccctgcctcttctggcctggtgtctcctcatgccccctcagtgaggatcttcatgtacctgctcttctgtttgcacacccagcatagcctccttgcaggcagaaggcagtagggcccctgcacactcagtttctctcgttttccttagttatcagtcctgtcctgtcccactcaggtctgtacttagggcagctggcctggatgggcttcactggggccctgtctgtgtgctgagccagtttcccctgctggctgcaagctgtgggttctttctcctctgtgcccctcatgctgatcttctagatgccactcccaaatccccttcatacccaccaggatgtgtgcccagccaggcctccagcacccccagtgcagctcgtgattggaaactcaccatcggcaggcagtggttcggtttaagagatggcattagagggagcccagtctggatgtggacttggatgccctgtgggtatcagttctgctgacactttggcccgaaatagatccagtgctgagcaagcaatgtacaccagagcctcagtgagcccatctgcacagtggggagcatggagggatgggtttggcctgtgcttctgcttattcagtccttcagctcacggaagggatgctagtccgtgaaggtgacctcacagtactggttaattaaactttattgctcactgtccacttttgtgctgaa

SEQ ID NO: 189779 - DNA, 7200 bp, Homo sapiens
  Payload ID: 17481
  Gene Symbol: TIAM1
  Gene Name: T-cell lymphoma invasion and metastasis 1
  Uniprot ID: Q13009
  ENST ID: ENST00000286827
  CDS Start-End: 473-5248
gccccgcatcgtgcccggccccgtcgcggagatcccggacgaccgtcgcgggttgatggtcgcattccagatgtaaacagcttcagaagcctgacggtcatatggtagaatcactgtggactgagacccacctttctagacctgaagcccaggaggaggaagaggaggctggttggtaccatgggcataatgctctgaatcctagtctctcacctagtatgtgagcagtccctgcagatggcccatttggagatcttgacaaagcctcttctgtttccaatggggtttttggcgcattctcacagacttagatgaaactgtgatggccaccgcagggggcaggtgctgacatcgtccccagccctgtggctgttcatccggacatcatttccaacctcaatatctaaatgccacagtgctcttggagcaagttgggctggggaccactgttgccttttaagaccataaaaccatgggaaacgcagaaagtcaacatgtagagcacgagttttatggagaaaagcatgccagcctggggcgcaagcacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctgtcagagagccaattccttgggtgacttgtatgctcagaaaaactctggagtgacagcaaacggggggccggggagcaaatttgcaggctactgtcggaatttggtgtctgatattcccaatcttgcaaaccataagatgccaccagctgctgctgaagagactcctccgtacagtaattataacacacttccctgtaggaaatctcactgtctctctgaaggtgccaccaacccacaaattagccatagcaacagcatgcaaggcagaagagctaaaacaactcaggatgttaatgcaggcgagggcagtgagtttgcagacagtgggattgaaggggccactaccgacacggacctcctgtccaggcgatctaatgccaccaactccagctactcacccaccacaggccgggcctttgtgggcagcgacagcggcagcagctccaccggggatgcggctcgtcagggggtgtacgagaacttccggcgggagctggagatgagcaccaccaacagcgagagcctggaggaggccggctcggcgcacagcgatgagcagagcagcggcaccctgagctctccgggccagtcggacatcctgctgaccgccgcacagggcacggtgcgcaaggccggcgccctggccgtcaagaacttcctggtgcacaagaagaacaagaaggtggagtcagccacccggaggaagtggaagcactactgggtgtccctgaaaggatgcacgctatttttctacgagagcgacggcaggtctgggatagaccacaacagcatccccaaacacgccgtctgggtggagaacagcattgtgcaggcggtgcctgagcaccccaagaaggactttgtcttctgcctcagcaattccctgggtgatgccttcctttttcagaccactagccagacggagcttgaaaactggatcaccgccatccactctgcctgcgccactgcggtcgcgaggcaccaccacaaggaagacacgctccgactcctgaaatcagagatcaaaaaactggaacagaagattgacatggatgaaaagatgaagaaaatgggtgaaatgcagctgtcttcagtcactgactcaaagaaaaagaaaacaatattagatcagatctttgtctgggagcaaaatctcgagcagttccaaatggacctgtttcgtttccgctgttatttagccagccttcagggtggggagctgccaaaccccaaaaggcttctcgcttttgcaagtcgaccaacgaaagtggccatgggccgccttggaatcttttcggtatcatcgtttcatgccctggtggcagcacgcactggtgaaactggagtgagaagacgtactcaggccatgtccagatccgcgagcaagcgaaggagcaggttttcttctctgtggggtctggatactacctccaaaaagaagcagggacggccaagcatcaatcaggtgtttggagagggaaccgaagctgtaaagaaatctttagagggaatatttgatgacattgttccagatggcaagagggagaaagaagtggtcttacctaacgttcaccagcacaaccctgactgcgacatttgggtccacgagtatttcactccatcctggttctgtctgcccaataatcagcctgccctgacggtcgtccggccaggcgacactgcacgggacaccctggagctgatttgcaagacacatcaactggatcattctgctcattacctgcgcctgaaatttctaatagaaaacaaaatgcagctctatgttccacagcccgaggaagacatctatgagctgctgtacaaagaaattgaaatctgtccaaaagtcactcagagcatccacattgagaagtcagatacagctgctgatacttacgggttttcactttcttctgtggaagaagatggtattcgaaggctgtacgtgaatagtgtgaaggaaaccggtttagcttccaagaaaggcctgaaagcaggagatgagattcttgagatcaataatcgtgctgctgacgccctgaactcttctatgctcaaagatttcctctcacagccctcgctgggcctcctggtgaggacctaccccgagctggaggaaggagtggagctgctggaaagcccgccccaccgagtggacggccctgccgaccttggcgagagccccctcgcctttctcaccagcaacccagggcacagcctttgcagcgagcagggcagcagtgctgagaccgctccagaggagaccgaggggccagacttggaatcctcagatgagactgatcacagcagcaagagtacagaacaggtggccgcattttgccgcagtttgcatgagatgaacccctctgaccagagcccatctcctcaggactccacggggcctcagctggcgaccatgagacaactctcggatgcagataagctgcgcaaggtgatctgcgagctcctggagacggagcgcacctacgtgaaggatttaaactgtcttatggagagatacctaaagcctcttcaaaaagaaacttttctcacccaggatgagcttgacgtgctttttggaaatttaacggaaatggtagagtttcaagtagaattccttaaaactctagaagatggagtgagactggtacctgatttggaaaagcttgagaaggttgatcaatttaagaaagtgctgttctctctggggggatcattcctgtattatgctgaccgcttcaagctctacagtgccttctgcgccagccacacaaaagttcccaaggtcctggtgaaagccaagacagacacggctttcaaggcattcttggatgcccagaacccgaagcagcagcactcatccacgctggagtcgtacctcatcaagcccatccagaggatcctcaagtacccacttctgctcagggagctgttcgccctgaccgatgcggagagcgaggagcactaccacctggacgtggccatcaagaccatgaacaaggttgccagtcacatcaatgagatgcagaaaatccatgaagagtttggggctgtgtttgaccagctgattgctgaacagactggtgagaaaaaagaggttgcagatctgagcatgggagacctgcttttgcacactaccgtgatctggctgaacccgccggcctcgctgggcaagtggaaaaaggaaccagagttggcagcattcgtcttcaaaactgctgtggtccttgtgtataaagatggttccaaacagaagaagaaacttgtaggatctcacaggctttccatttatgaggactgggaccccttcagatttcgacacatgatccccacggaagcgctgcaggttcgagctttggcgagtgcagatgcagaggcaaatgccgtgtgtgaaattgtccatgtaaaatccgagtctgaagggaggccggagagggtctttcacttgtgctgcagctccccagagagccgaaaggatttcctaaaggctgtgcattcaatcctgcgtgataagcacagaagacagctcctcaaaaccgagagccttccctcatcccagcaatatgtcccttttggaggcaaaagattgtgtgcactgaagggggccaggccggccatgagcagggcagtgtctgccccaagcaagtctcttgggaggaggaggcggcggctggctcgaaacaggtttaccattgattctgatgccgtctccgcaagcagcccggagaaagagtcccagcagccccccggtggtggggacactgaccgatgggtagaggagcagtttgatcttgctcagtatgaggagcaagatgacatcaaggagacagacatcctcagtgacgatgatgagttctgtgagtccgtgaagggtgcctcagtggacagagacctgcaggagcggcttcaggccacctccatcagtcagcgggaaagaggccggaaaaccctggatagtcacgcgtcccgcatggcacagctcaagaagcaagctgccctgtcggggatcaatggaggcctggagagcgcaagcgaggaagtcatttgggttaggcgtgaagactttgccccctccaggaaactgaacactgagatctgactgcgtcacctgccccgtagagaatgtgtgtagatacttcctgccctaactctgcccaccctcctgtaccgtcgacaagaatgtccccttaggtcgcgctcttgcacacacggttttggcagctgacttggttctgaagccatgtagccacccaactttgtcattttcaacaacatcagaaagaattgatcagaatcccaaataagcttgagtcctatcttctgtatattactaagggcttttatttattctcaataaatcagggcctgaacaattaaaagaaaaaagattctatagcactggaaagcaaatcaccccaggagttaacggatgtacaacagattaatttaagggatagtagcacacacacgatccttctatctgaaatcagtctcctagctggggaaacctctttcacacacaaaatgaaatgtgtacagcttgccgtgttctgactgtacccttccctcttccatgtctgagaatctccgtgtattttaagaatgtgtgaggagagggtggcgattcatgtttcaatgagcctctttttttttttccttcctgttttggtctatggctggtcttactctgtgtccatgttcggaagctctagttttgcatagaattatagagatgccaaactctttgaaaagagatccaaatttatcgcttgagagaaagaaaagaaacactattttttgtattttacctgagatacaggggcacaaatagatgagaattttacagtgttagtgtatgtatccctgagcctaaaaaatgaggatataaccttttacagagagagtgaggcgtggtggttttatatttatatatgaaaggccagcaagctcatgcgaaggatatacttttcttccaaaaagcggattttttttttttaatgtttgaatctatatttgagatgggagtttggttggattaaacatgacaccccggtgggcggtgtgtgtgtctgttgcacatggcagggaggggagcctccttctcatggggttgccatggtgatcattggtttttccatcaaaattgcatcttcatccatagattaccttccccttccctgacagtccataaccaaacctttaaacagaacaacctctttaaaaacttctcttgtgtttaacactttcttcatgccaacgaaacagggtaaacatgctcaaaacattaacagtctaaacagatatccaaatactaagaagaaaaacaagttatagcactttcaattttttttttttttttaaaaaaaggtttatagctttttcttttcccatgtcacaatgtccacttcctaagaagggtttaaaatactatgaaaactttctttttggggaaaatatctatttggtgtttgacacatcagtaggtactttaaagacctgaattttatagtagctttaggagttatattttataaaaatcagttatgactttatatttccagacaatagagagttcagtacatcatgctcttgtgcctctgcctgcttttcctgcgttcccaccctgtattccccccgcctttcgggtttccagggcttcgagcttgatcttttgaaagttttattctattaaatttttgctatatcttctggttttctgaaaaagctttagaatggtttctataccctttgtatcactgcatttttccatatcatctccggttcgatcgcgtccagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtcaaacaataaaaataacgaaaagtgtc

SEQ ID NO: 189780 - DNA, 1187 bp, Homo sapiens
  Payload ID: 17481
  Gene Symbol: TIAM1
  Gene Name: T-cell lymphoma invasion and metastasis 1
  ENST ID: ENST00000455508
  CDS Start-End: 511-1187
atcatagcacgaaacttcacaagttacacccactgcctccgccagcagccggggaaggctgctgcttcctcatttctgttactggaagtttgggacatgtgaagccagacggggagaaacgtgcgcgccttgttgagcagcggtagaatcactgtggactgagacccacctttctagacctgaagcccaggaggaggaagaggaggctggttggtaccatgggcataatgctctgaatcctagtctctcacctagtatgtgagcagtccctgcagatggcccatttggagatcttgacaaagcctcttctgtttccaatggggtttttggcgcattctcacagacttagatgaaactgtgatggccaccgcagggggcaggtgctgacatcgtccccagccctgtggctgttcatccggacatcatttccaacctcaatatctaaatgccacagtgctcttggagcaagttgggctggggaccactgttgccttttaagaccataaaaccatgggaaacgcagaaagtcaacatgtagagcacgagttttatggagaaaagcatgccagcctggggcgcaagcacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctg

SEQ ID NO: 189781 - DNA, 523 bp, Homo sapiens
  Payload ID: 17481
  Gene Symbol: TIAM1
  Gene Name: T-cell lymphoma invasion and metastasis 1
  ENST ID: ENST00000423206
  CDS Start-End: 1-398
cgagtgcagatgcagaggcaaatgccgtgtgtgaaattgtccatgtaaaatccgagtctgaagggaggccggagagggtctttcacttgtgctgcagctccccagagagccgaaaggatttcctaaaggctgtgcattcaatcctgcgtgataagcacagaagacagctcctcaaaaccgagagccttccctcatcccagcaatatgtcccttttggaggcaaaagattgtgtgcactgaagggggccaggccggccatgagcagggcagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtcaaacaataaaaataacgaaaagtg

SEQ ID NO: 189782 - DNA, 7018 bp, Homo sapiens
  Payload ID: 17481
  Gene Symbol: TIAM1
  Gene Name: T-cell lymphoma invasion and metastasis 1
  Uniprot ID: Q13009
  ENST ID: ENST00000541036
  CDS Start-End: 473-5068
gccccgcatcgtgcccggccccgtcgcggagatcccggacgaccgtcgcgggttgatggtcgcattccagatgtaaacagcttcagaagcctgacggtcatatggtagaatcactgtggactgagacccacctttctagacctgaagcccaggaggaggaagaggaggctggttggtaccatgggcataatgctctgaatcctagtctctcacctagtatgtgagcagtccctgcagatggcccatttggagatcttgacaaagcctcttctgtttccaatggggtttttggcgcattctcacagacttagatgaaactgtgatggccaccgcagggggcaggtgctgacatcgtccccagccctgtggctgttcatccggacatcatttccaacctcaatatctaaatgccacagtgctcttggagcaagttgggctggggaccactgttgccttttaagaccataaaaccatgggaaacgcagaaagtcaacatgtagagcacgagttttatggagaaaagcatgccagcctggggcgcaagcacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctgtcagagagccaattccttgggtgacttgtatgctcagaaaaactctggagtgacagcaaacggggggccggggagcaaatttgcaggctactgtcggaatttggtgtctgatattcccaatcttgcaaaccataagatgccaccagctgctgctgaagagactcctccgtacagtaattataacacacttccctgtaggaaatctcactgtctctctgaaggtgccaccaacccacaaattagccatagcaacagcatgcaaggcagaagagctaaaacaactcaggatgttaatgcaggcgagggcagtgagtttgcagacagtgggattgaaggggccactaccgacacggacctcctgtccaggcgatctaatgccaccaactccagctactcacccaccacaggccgggcctttgtgggcagcgacagcggcagcagctccaccggggatgcggctcgtcagggggtgtacgagaacttccggcgggagctggagatgagcaccaccaacagcgagagcctggaggaggccggctcggcgcacagcgatgagcagagcagcggcaccctgagctctccgggccagtcggacatcctgctgaccgccgcacagggcacggtgcgcaaggccggcgccctggccgtcaagaacttcctggtgcacaagaagaacaagaaggtggagtcagccacccggaggaagtggaagcactactgggtgtccctgaaaggatgcacgctatttttctacgagagcgacggcaggtctgggatagaccacaacagcatccccaaacacgccgtctgggtggagaacagcattgtgcaggcggtgcctgagcaccccaagaaggactttgtcttctgcctcagcaattccctgggtgatgccttcctttttcagaccactagccagacggagcttgaaaactggatcaccgccatccactctgcctgcgccactgcggtcgcgaggcaccaccacaaggaagacacgctccgactcctgaaatcagagatcaaaaaactggaacagaagattgacatggatgaaaagatgaagaaaatgggtgaaatgcagctgtcttcagtcactgactcaaagaaaaagaaaacaatattagatcagatctttgtctgggagcaaaatctcgagcagttccaaatggacctgtttcgtttccgctgttatttagccagccttcagggtggggagctgccaaaccccaaaaggcttctcgcttttgcaagtcgaccaacgaaagtggccatgggccgccttggaatcttttcggtatcatcgtttcatgccctggtggcagcacgcactggtgaaactggagtgagaagacgtactcaggccatgtccagatccgcgagcaagcgaaggagcaggttttcttctctgtggggtctggatactacctccaaaaagaagcagggacggccaagcatcaatcagagggagaaagaagtggtcttacctaacgttcaccagcacaaccctgactgcgacatttgggtccacgagtatttcactccatcctggttctgtctgcccaataatcagcctgccctgacggtcgtccggccaggcgacactgcacgggacaccctggagctgatttgcaagctgtacaaagaaattgaaatctgtccaaaagtcactcagagcatccacattgagaagtcagatacagctgctgatacttacgggttttcactttcttctgtggaagaagatggtattcgaaggctgtacgtgaatagtgtgaaggaaaccggtttagcttccaagaaaggcctgaaagcaggagatgagattcttgagatcaataatcgtgctgctgacgccctgaactcttctatgctcaaagatttcctctcacagccctcgctgggcctcctggtgaggacctaccccgagctggaggaaggagtggagctgctggaaagcccgccccaccgagtggacggccctgccgaccttggcgagagccccctcgcctttctcaccagcaacccagggcacagcctttgcagcgagcagggcagcagtgctgagaccgctccagaggagaccgaggggccagacttggaatcctcagatgagactgatcacagcagcaagagtacagaacaggtggccgcattttgccgcagtttgcatgagatgaacccctctgaccagagcccatctcctcaggactccacggggcctcagctggcgaccatgagacaactctcggatgcagataagctgcgcaaggtgatctgcgagctcctggagacggagcgcacctacgtgaaggatttaaactgtcttatggagagatacctaaagcctcttcaaaaagaaacttttctcacccaggatgagcttgacgtgctttttggaaatttaacggaaatggtagagtttcaagtagaattccttaaaactctagaagatggagtgagactggtacctgatttggaaaagcttgagaaggttgatcaatttaagaaagtgctgttctctctggggggatcattcctgtattatgctgaccgcttcaagctctacagtgccttctgcgccagccacacaaaagttcccaaggtcctggtgaaagccaagacagacacggctttcaaggcattcttggatgcccagaacccgaagcagcagcactcatccacgctggagtcgtacctcatcaagcccatccagaggatcctcaagtacccacttctgctcagggagctgttcgccctgaccgatgcggagagcgaggagcactaccacctggacgtggccatcaagaccatgaacaaggttgccagtcacatcaatgagatgcagaaaatccatgaagagtttggggctgtgtttgaccagctgattgctgaacagactggtgagaaaaaagaggttgcagatctgagcatgggagacctgcttttgcacactaccgtgatctggctgaacccgccggcctcgctgggcaagtggaaaaaggaaccagagttggcagcattcgtcttcaaaactgctgtggtccttgtgtataaagatggttccaaacagaagaagaaacttgtaggatctcacaggctttccatttatgaggactgggaccccttcagatttcgacacatgatccccacggaagcgctgcaggttcgagctttggcgagtgcagatgcagaggcaaatgccgtgtgtgaaattgtccatgtaaaatccgagtctgaagggaggccggagagggtctttcacttgtgctgcagctccccagagagccgaaaggatttcctaaaggctgtgcattcaatcctgcgtgataagcacagaagacagctcctcaaaaccgagagccttccctcatcccagcaatatgtcccttttggaggcaaaagattgtgtgcactgaagggggccaggccggccatgagcagggcagtgtctgccccaagcaagtctcttgggaggaggaggcggcggctggctcgaaacaggtttaccattgattctgatgccgtctccgcaagcagcccggagaaagagtcccagcagccccccggtggtggggacactgaccgatgggtagaggagcagtttgatcttgctcagtatgaggagcaagatgacatcaaggagacagacatcctcagtgacgatgatgagttctgtgagtccgtgaagggtgcctcagtggacagagacctgcaggagcggcttcaggccacctccatcagtcagcgggaaagaggccggaaaaccctggatagtcacgcgtcccgcatggcacagctcaagaagcaagctgccctgtcggggatcaatggaggcctggagagcgcaagcgaggaagtcatttgggttaggcgtgaagactttgccccctccaggaaactgaacactgagatctgactgcgtcacctgccccgtagagaatgtgtgtagatacttcctgccctaactctgcccaccctcctgtaccgtcgacaagaatgtccccttaggtcgcgctcttgcacacacggttttggcagctgacttggttctgaagccatgtagccacccaactttgtcattttcaacaacatcagaaagaattgatcagaatcccaaataagcttgagtcctatcttctgtatattactaagggcttttatttattctcaataaatcagggcctgaacaattaaaagaaaaaagattctatagcactggaaagcaaatcaccccaggagttaacggatgtacaacagattaatttaagggatagtagcacacacacgatccttctatctgaaatcagtctcctagctggggaaacctctttcacacacaaaatgaaatgtgtacagcttgccgtgttctgactgtacccttccctcttccatgtctgagaatctccgtgtattttaagaatgtgtgaggagagggtggcgattcatgtttcaatgagcctctttttttttttccttcctgttttggtctatggctggtcttactctgtgtccatgttcggaagctctagttttgcatagaattatagagatgccaaactctttgaaaagagatccaaatttatcgcttgagagaaagaaaagaaacactattttttgtattttacctgagatacaggggcacaaatagatgagaattttacagtgttagtgtatgtatccctgagcctaaaaaatgaggatataaccttttacagagagagtgaggcgtggtggttttatatttatatatgaaaggccagcaagctcatgcgaaggatatacttttcttccaaaaagcggattttttttttttaatgtttgaatctatatttgagatgggagtttggttggattaaacatgacaccccggtgggcggtgtgtgtgtctgttgcacatggcagggaggggagcctccttctcatggggttgccatggtgatcattggtttttccatcaaaattgcatcttcatccatagattaccttccccttccctgacagtccataaccaaacctttaaacagaacaacctctttaaaaacttctcttgtgtttaacactttcttcatgccaacgaaacagggtaaacatgctcaaaacattaacagtctaaacagatatccaaatactaagaagaaaaacaagttatagcactttcaattttttttttttttttaaaaaaaggtttatagctttttcttttcccatgtcacaatgtccacttcctaagaagggtttaaaatactatgaaaactttctttttggggaaaatatctatttggtgtttgacacatcagtaggtactttaaagacctgaattttatagtagctttaggagttatattttataaaaatcagttatgactttatatttccagacaatagagagttcagtacatcatgctcttgtgcctctgcctgcttttcctgcgttcccaccctgtattccccccgcctttcgggtttccagggcttcgagcttgatcttttgaaagttttattctattaaatttttgctatatcttctggttttctgaaaaagctttagaatggtttctataccctttgtatcactgcatttttccatatcatctccggttcgatcgcgtccagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtcaaacaataaaaataacgaaaagtg

SEQ ID NO: 189783 - DNA, 2491 bp, Homo sapiens
  Payload ID: 17482
  Gene Symbol: TIAM2
  Gene Name: T-cell lymphoma invasion and metastasis 2
  Uniprot ID: Q8IVF5
  ENST ID: ENST00000275246
  CDS Start-End: 512-2392
acaatgtccctttgggtgaggaggttgaaagagtttttggtttgttctgggaacttaaggtatattaagcagtccccacagacatgctgcctgcactccacctgctgagctggctctgaggctcaggagacgtggccctctgtggtcccattgtctccacgtctgtggtaacccggtgcctttctagagcaggcaggctcccggcatgggtggaaacagagcagggggccagcttcccccaatcaccggtgctgctgtggaggaagagcttggtggcgctaggacgtccttgtgaatgtgacttggaagagcagtttgggatttttttcattgcctggggatgagagggagagacaacgtgtgtcttacacatctcccaacagccgacttagatgtgatccgttctcccagagggagcaggtttctttgaacttttcctttttatgtacagcatagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaaaactgttcatt

SEQ ID NO: 189784 - DNA, 5916 bp, Homo sapiens
  Payload ID: 17482
  Gene Symbol: TIAM2
  Gene Name: T-cell lymphoma invasion and metastasis 2
  Uniprot ID: Q8IVF5
  ENST ID: ENST00000318981
  CDS Start-End: 209-5314
ggctctgtgtatgaatgacaaggataccttcagccagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtctccagaggtgttgcctactccacgcacaggacaaatgccccagggaaggatttccagggcatcagtgctgctttctcaactgagaatggcttccactctgttggccacgagctggcagataaccacatcacctccagagactgcaacggacaccttctcaactgctacgggaggaatgagagcattgcctccaccccaccgggcgaagaccgcaagagcccccgagtgctcatcaaaacgctggggaagctggatgggtgtttaagggtcgagttccacaatggtggcaaccccagcaaagtgcctgcagaggactgcagtgagccggtgcagctgctgaggtactcacctaccttagcatcggaaacctcccctgtgcctgaagccaggagggggtccagcgccgattccctgcccagccatcgcccctctcccacggactctcgcctgcggtccagcaaaggcagctccctgagttctgagtcatcctggtacgactccccttggggcaatgctggagagctgagcgaggctgagggctccttcctggcccccggcatgcctgaccccagtctccatgccagcttcccacctggcgatgccaaaaagcctttcaaccaaagctcttccctctcctccctccgggaactgtacaaagatgccaacctggggagcctctccccctcaggtatccgcctttctgatgaatacatgggcacgcatgccagcctgagcaaccgtgtctcttttgcttccgacattgatgtgccctccagagtggcacacggggaccccatccagtacagttccttcactctcccctgtcggaagcccaaagcctttgttgaggatactgcgaagaaggactccctcaaagccaggatgcgacggatcagtgactggacgggaagcctctcaaggaagaaaaggaaactccaggagccgaggtccaaggagggcagtgactactttgacagtcgctctgatggactgaatacagatgtgcagggatcctcccaggcatctgcttttctgtggtcagggggctctactcagatcctgtctcagagaagtgaatccacacatgcgattggcagcgatcccctccggcagaacatttatgagaatttcatgcgagagttggaaatgagcaggaccaacactgagaacatagaaacatctacagaaaccgccgagtccagcagcgagtcactcagctctctggaacagctggatctgctctttgagaaggaacagggggtggtccggaaggccgggtggctcttcttcaagcccctggtcactgtgcagaaggaaaggaagcttgagctggtggcacgaaggaaatggaaacagtactgggtaacgctgaaaggatgcacgctgctgttttatgagacctatgggaagaattccatggatcagagcagtgcccctcggtgtgctctgtttgcagaagacagcatagtgcagtctgttccagagcatcccaagaaagaaaatgtgttctgcctcagcaactcctttggagatgtctaccttttccaggccaccagccagacagatctagaaaactgggtcactgctgtacactctgcttgtgcatccctttttgcaaagaagcatgggaaagaggacacgctgcggctgctgaagaaccagaccaaaaacctgcttcagaagatagacatggacagcaagatgaagaagatggcagagctgcagctgtccgtggtgagcgacccaaagaacaggaaagccatagagaaccagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaaaactgttcattcctgggttttgtgcagtatacattttcccacaaaatggttgtaaagatttaagttattttaatttattgtggatcagaaacctagatgaaactggtcagaatctgtaaattacttagtttatatccactttgagcaggtatcaaatgatttaggatccttaaaattacattctaataattaagttatgtggaaaaagtaaggctggggaagtcgtgattaatagttttcaaagggccattttttaaaatcctctgggcattttctttcagctgtttgttagtttttgctttatttaaagcatatttaagttattttaatgtggtttaggggcaaaatgtgcagatacttcatttttgtaagatagattgtaatagatgctgtttatactaaacatgtcataactatctatacagtatatattaaaagaaagcttgtactgtatcttatttgatgatatttattttctctgccaagctgtatagtaaaaggaaaataagtcaca

SEQ ID NO: 189785 - DNA, 5771 bp, Homo sapiens
  Payload ID: 17482
  Gene Symbol: TIAM2
  Gene Name: T-cell lymphoma invasion and metastasis 2
  Uniprot ID: Q8IVF5
  ENST ID: ENST00000360366
  CDS Start-End: 53-5230
tgtaatttaggccacggtcttactgatgcaactgttcttaatttaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtctccagaggtgttgcctactccacgcacaggacaaatgccccagggaaggatttccagggcatcagtgctgctttctcaactgagaatggcttccactctgttggccacgagctggcagataaccacatcacctccagagactgcaacggacaccttctcaactgctacgggaggaatgagagcattgcctccaccccaccgggcgaagaccgcaagagcccccgagtgctcatcaaaacgctggggaagctggatgggtgtttaagggtcgagttccacaatggtggcaaccccagcaaagtgcctgcagaggactgcagtgagccggtgcagctgctgaggtactcacctaccttagcatcggaaacctcccctgtgcctgaagccaggagggggtccagcgccgattccctgcccagccatcgcccctctcccacggactctcgcctgcggtccagcaaaggcagctccctgagttctgagtcatcctggtacgactccccttggggcaatgctggagagctgagcgaggctgagggctccttcctggcccccggcatgcctgaccccagtctccatgccagcttcccacctggcgatgccaaaaagcctttcaaccaaagctcttccctctcctccctccgggaactgtacaaagatgccaacctggggagcctctccccctcaggtatccgcctttctgatgaatacatgggcacgcatgccagcctgagcaaccgtgtctcttttgcttccgacattgatgtgccctccagagtggcacacggggaccccatccagtacagttccttcactctcccctgtcggaagcccaaagcctttgttgaggatactgcgaagaaggactccctcaaagccaggatgcgacggatcagtgactggacgggaagcctctcaaggaagaaaaggaaactccaggagccgaggtccaaggagggcagtgactactttgacagtcgctctgatggactgaatacagatgtgcagggatcctcccaggcatctgcttttctgtggtcagggggctctactcagatcctgtctcagagaagtgaatccacacatgcgattggcagcgatcccctccggcagaacatttatgagaatttcatgcgagagttggaaatgagcaggaccaacactgagaacatagaaacatctacagaaaccgccgagtccagcagcgagtcactcagctctctggaacagctggatctgctctttgagaaggaacagggggtggtccggaaggccgggtggctcttcttcaagcccctggtcactgtgcagaaggaaaggaagcttgagctggtggcacgaaggaaatggaaacagtactgggtaacgctgaaaggatgcacgctgctgttttatgagacctatgggaagaattccatggatcagagcagtgcccctcggtgtgctctgtttgcagaagacagcatagtgcagtctgttccagagcatcccaagaaagaaaatgtgttctgcctcagcaactcctttggagatgtctaccttttccaggccaccagccagacagatctagaaaactgggtcactgctgtacactctgcttgtgcatccctttttgcaaagaagcatgggaaagaggacacgctgcggctgctgaagaaccagaccaaaaacctgcttcagaagatagacatggacagcaagatgaagaagatggcagagctgcagctgtccgtggtgagcgacccaaagaacaggaaagccatagagaaccagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcagatatttgattcaagtggcagccatggattttctggaactcagctacctcaaaactccagtaactccagtgaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaaaactgttcattcctgggttttgtgcagtatacattttcccacaaaatggttgtaaagatttaagttattttaatttattgtggatcagaaacctagatgaaactggtcagaatctgtaaattacttagtttatatccactttgagcaggtatcaaatgatttaggatccttaaaattacattctaataattaagttatgtggaaaaagtaaggctggggaagtcgtgattaatagttttcaaagggccattttttaaaatcctctgggcattttctttcagctgtttgttagtttttgctttatttaaagcatatttaagttattttaatgtggtttaggggcaaaatgtgcagatacttcatttttgtaagatagattgtaatagatgctgtttatactaaacatgtcataactatctatacagtatatattaaaagaaagcttgtactgta

SEQ ID NO: 189786 - DNA, 3275 bp, Homo sapiens
  Payload ID: 17482
  Gene Symbol: TIAM2
  Gene Name: T-cell lymphoma invasion and metastasis 2
  Uniprot ID: Q8IVF5
  ENST ID: ENST00000456877
  CDS Start-End: 155-3196
agcttgtcccacagcgagctgtggagctgggagggccattcagagctctgcatggaggcagggtggccggccttcgtcccctcaggccagcagggcaaggcagctcccctcaatagagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaa

SEQ ID NO: 189787 - DNA, 583 bp, Homo sapiens
  Payload ID: 17482
  Gene Symbol: TIAM2
  Gene Name: T-cell lymphoma invasion and metastasis 2
  ENST ID: ENST00000462408
  CDS Start-End: 115-583
attgcctggggatgagagggagagacaacgtgtgtcttacacatctcccaacagccgacttagatgtgatccgttctcccagagggagcaggtttctttgaacttttcctttttatgtacagcatgagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagcta

SEQ ID NO: 189788 - DNA, 5262 bp, Homo sapiens
  Payload ID: 17482
  Gene Symbol: TIAM2
  Gene Name: T-cell lymphoma invasion and metastasis 2
  Uniprot ID: Q8IVF5
  ENST ID: ENST00000529824
  CDS Start-End: 1-5193
atgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtctccagaggtgttgcctactccacgcacaggacaaatgccccagggaaggatttccagggcatcagtgctgctttctcaactgagaatggcttccactctgttggccacgagctggcagataaccacatcacctccagagactgcaacggacaccttctcaactgctacgggaggaatgagagcattgcctccaccccaccgggcgaagaccgcaagagcccccgagtgctcatcaaaacgctggggaagctggatgggtgtttaagggtcgagttccacaatggtggcaaccccagcaaagtgcctgcagaggactgcagtgagccggtgcagctgctgaggtactcacctaccttagcatcggaaacctcccctgtgcctgaagccaggagggggtccagcgccgattccctgcccagccatcgcccctctcccacggactctcgcctgcggtccagcaaaggcagctccctgagttctgagtcatcctggtacgactccccttggggcaatgctggagagctgagcgaggctgagggctccttcctggcccccggcatgcctgaccccagtctccatgccagcttcccacctggcgatgccaaaaagcctttcaaccaaagctcttccctctcctccctccgggaactgtacaaagatgccaacctggggagcctctccccctcaggtatccgcctttctgatgaatacatgggcacgcatgccagcctgagcaaccgtgtctcttttgcttccgacattgatgtgccctccagagtggcacacggggaccccatccagtacagttccttcactctcccctgtcggaagcccaaagcctttgttgaggatactgcgaagaaggactccctcaaagccaggatgcgacggatcagtgactggacgggaagcctctcaaggaagaaaaggaaactccaggagccgaggtccaaggagggcagtgactactttgacagtcgctctgatggactgaatacagatgtgcagggatcctcccaggcatctgcttttctgtggtcagggggctctactcagatcctgtctcagagaagtgaatccacacatgcgattggcagcgatcccctccggcagaacatttatgagaatttcatgcgagagttggaaatgagcaggaccaacactgagaacatagaaacatctacagaaaccgccgagtccagcagcgagtcactcagctctctggaacagctggatctgctctttgagaaggaacagggggtggtccggaaggccgggtggctcttcttcaagcccctggtcactgtgcagaaggaaaggaagcttgagctggtggcacgaaggaaatggaaacagtactgggtaacgctgaaaggatgcacgctgctgttttatgagacctatgggaagaattccatggatcagagcagtgcccctcggtgtgctctgtttgcagaagacagcatagtgcagtctgttccagagcatcccaagaaagaaaatgtgttctgcctcagcaactcctttggagatgtctaccttttccaggccaccagccagacagatctagaaaactgggtcactgctgtacactctgcttgtgcatccctttttgcaaagaagcatgggaaagaggacacgctgcggctgctgaagaaccagaccaaaaacctgcttcagaagatagacatggacagcaagatgaagaagatggcagagctgcagctgtccgtggtgagcgacccaaagaacaggaaagccatagagaaccagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggagcagcccgaatggagctcagaggtgatggatgtactagatcccaggggaaagcttacaaaaggcactctggaagaaccacggacactggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgc

SEQ ID NO: 189789 - DNA, 4404 bp, Homo sapiens
  Payload ID: 17482
  Gene Symbol: TIAM2
  Gene Name: T-cell lymphoma invasion and metastasis 2
  ENST ID: ENST00000528535
  CDS Start-End: 304-4404
acacacacacacacacacacacacacacacacctgagatggggtagatcattgtatttttgtgtctaccagcaagaaaaggaaggaaaaactaagggctctgtgtatgaatgacaaggataccttcagccagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtctccagaggtgttgcctactccacgcacaggacaaatgccccagggaaggatttccagggcatcagtgctgctttctcaactgagaatggcttccactctgttggccacgagctggcagataaccacatcacctccagagactgcaacggacaccttctcaactgctacgggaggaatgagagcattgcctccaccccaccgggcgaagaccgcaagagcccccgagtgctcatcaaaacgctggggaagctggatgggtgtttaagggtcgagttccacaatggtggcaaccccagcaaagtgcctgcagaggactgcagtgagccggtgcagctgctgaggtactcacctaccttagcatcggaaacctcccctgtgcctgaagccaggagggggtccagcgccgattccctgcccagccatcgcccctctcccacggactctcgcctgcggtccagcaaaggcagctccctgagttctgagtcatcctggtacgactccccttggggcaatgctggagagctgagcgaggctgagggctccttcctggcccccggcatgcctgaccccagtctccatgccagcttcccacctggcgatgccaaaaagcctttcaaccaaagctcttccctctcctccctccgggaactgtacaaagatgccaacctggggagcctctccccctcaggtatccgcctttctgatgaatacatgggcacgcatgccagcctgagcaaccgtgtctcttttgcttccgacattgatgtgccctccagagtggcacacggggaccccatccagtacagttccttcactctcccctgtcggaagcccaaagcctttgttgaggatactgcgaagaaggactccctcaaagccaggatgcgacggatcagtgactggacgggaagcctctcaaggaagaaaaggaaactccaggagccgaggtccaaggagggcagtgactactttgacagtcgctctgatggactgaatacagatgtgcagggatcctcccaggcatctgcttttctgtggtcagggggctctactcagatcctgtctcagagaagtgaatccacacatgcgattggcagcgatcccctccggcagaacatttatgagaatttcatgcgagagttggaaatgagcaggaccaacactgagaacatagaaacatctacagaaaccgccgagtccagcagcgagtcactcagctctctggaacagctggatctgctctttgagaaggaacagggggtggtccggaaggccgggtggctcttcttcaagcccctggtcactgtgcagaaggaaaggaagcttgagctggtggcacgaaggaaatggaaacagtactgggtaacgctgaaaggatgcacgctgctgttttatgagacctatgggaagaattccatggatcagagcagtgcccctcggtgtgctctgtttgcagaagacagcatagtgcagtctgttccagagcatcccaagaaagaaaatgtgttctgcctcagcaactcctttggagatgtctaccttttccaggccaccagccagacagatctagaaaactgggtcactgctgtacactctgcttgtgcatccctttttgcaaagaagcatgggaaagaggacacgctgcggctgctgaagaaccagaccaaaaacctgcttcagaagatagacatggacagcaagatgaagaagatggcagagctgcagctgtccgtggtgagcgacccaaagaacaggaaagccatagagaaccagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgc

SEQ ID NO: 189790 - DNA, 3349 bp, Homo sapiens
  Payload ID: 17482
  Gene Symbol: TIAM2
  Gene Name: T-cell lymphoma invasion and metastasis 2
  ENST ID: ENST00000528391
  CDS Start-End: 143-3280
agcgagctgtggagctgggagggccattcagagctctgcatggaggcagggtggccggccttcgtcccctcaggccagcagggcaaggcagctcccctcaatagagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcagatatttgattcaagtggcagccatggattttctggaactcagctacctcaaaactccagtaactccagtgaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcgaaatgtgtttttctcactgtagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgc

SEQ ID NO: 189791 - DNA, 6981 bp, Homo sapiens
  Payload ID: 17482
  Gene Symbol: TIAM2
  Gene Name: T-cell lymphoma invasion and metastasis 2
  Uniprot ID: Q8IVF5
  ENST ID: ENST00000461783
  CDS Start-End: 1274-6379
gggcggcctatagatccaagagaaggtcctggacggcctccactagatggtagggatcattttggaagacctcctgtagatataagagagaatcttgtgaggccaggtatagatcatcttggtcgaagagaccactttggctttaatccagagaagccctgggggcatagaggagattttgatgagagagagcatcgggttctaccggtctatggtggtccaaaaggcttacatgaagaaagaggtagatttcggtctggaaactatcgatttgatcctagaagtggtccttggaaccgaggatttggacaagaagttcacagagattttgatgaccgcagaagaccctgggagaggcaaagggatagggatgacagagattttgatttctgcagagaaatgaatggaaatcgtcttggacgagacagaattcaaaacacttgggttccccctcctcatgctcgggtttttgattattttgaaggggccacttctcaacgaaaaggtgataatgtgcctcaggttaatggtgaaaatacagagagacatgctcagccaccacctataccagtacagaatgatcctgaactttatgaaaaactgacatcttcaaatgaaataaacaaggagaagagtgacacagttgctgatatagaaagtgaaccagtggtagaaagcacagaaactgaggggacataatcatcactcagtaggttaatgatgaaatggcaggtaattcacacttttggacagagcgcaccgcccccgtggaatcaccctacagaagaggccagctataaaggatgtctcacacctttaagatcagtgtttctcaatgtgtggaccatggatacctgtattagaatacccaaaggatttgtttaaaattcaggctgagcccttcccaagacctaatagagctaaaagctttgggagtaggtggaggaaacctgcatctttacccagcaatccaggacagaatgacttggaagataacggagcttcgaagcttctagcagaatatgaagtctttcgtcttcagctacctgggttaagtttaagcagggctctgtgtatgaatgacaaggataccttcagccagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtctccagaggtgttgcctactccacgcacaggacaaatgccccagggaaggatttccagggcatcagtgctgctttctcaactgagaatggcttccactctgttggccacgagctggcagataaccacatcacctccagagactgcaacggacaccttctcaactgctacgggaggaatgagagcattgcctccaccccaccgggcgaagaccgcaagagcccccgagtgctcatcaaaacgctggggaagctggatgggtgtttaagggtcgagttccacaatggtggcaaccccagcaaagtgcctgcagaggactgcagtgagccggtgcagctgctgaggtactcacctaccttagcatcggaaacctcccctgtgcctgaagccaggagggggtccagcgccgattccctgcccagccatcgcccctctcccacggactctcgcctgcggtccagcaaaggcagctccctgagttctgagtcatcctggtacgactccccttggggcaatgctggagagctgagcgaggctgagggctccttcctggcccccggcatgcctgaccccagtctccatgccagcttcccacctggcgatgccaaaaagcctttcaaccaaagctcttccctctcctccctccgggaactgtacaaagatgccaacctggggagcctctccccctcaggtatccgcctttctgatgaatacatgggcacgcatgccagcctgagcaaccgtgtctcttttgcttccgacattgatgtgccctccagagtggcacacggggaccccatccagtacagttccttcactctcccctgtcggaagcccaaagcctttgttgaggatactgcgaagaaggactccctcaaagccaggatgcgacggatcagtgactggacgggaagcctctcaaggaagaaaaggaaactccaggagccgaggtccaaggagggcagtgactactttgacagtcgctctgatggactgaatacagatgtgcagggatcctcccaggcatctgcttttctgtggtcagggggctctactcagatcctgtctcagagaagtgaatccacacatgcgattggcagcgatcccctccggcagaacatttatgagaatttcatgcgagagttggaaatgagcaggaccaacactgagaacatagaaacatctacagaaaccgccgagtccagcagcgagtcactcagctctctggaacagctggatctgctctttgagaaggaacagggggtggtccggaaggccgggtggctcttcttcaagcccctggtcactgtgcagaaggaaaggaagcttgagctggtggcacgaaggaaatggaaacagtactgggtaacgctgaaaggatgcacgctgctgttttatgagacctatgggaagaattccatggatcagagcagtgcccctcggtgtgctctgtttgcagaagacagcatagtgcagtctgttccagagcatcccaagaaagaaaatgtgttctgcctcagcaactcctttggagatgtctaccttttccaggccaccagccagacagatctagaaaactgggtcactgctgtacactctgcttgtgcatccctttttgcaaagaagcatgggaaagaggacacgctgcggctgctgaagaaccagaccaaaaacctgcttcagaagatagacatggacagcaagatgaagaagatggcagagctgcagctgtccgtggtgagcgacccaaagaacaggaaagccatagagaaccagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaagatgaggcagttggaacccagccattatggcctacagcttcgaaaattagtagatgacaatgttgagtattgcatccctgcaccatatgaatatatgcaacaacaggtttatgatgaaatagaagtctttccactaaatgtttatgacgtgcagctcacgaagactgggagtgtgtgtgactttgggtttgcagttacagcgcaggtggatgagcgtcagcatctcagccggatatttataagcgacgttcttcccgatggcctggcgtatggggaagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgatttcagcaacgtccctgatatcacaacaggtctgaaaaggagtcagacagatggcactctggatcaggtttcccacagggagaaaatggagcagacattcaggagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttcccttggaggctctttcctttattacgcggaccactttaaactgtacagtggattctgtgctaaccatatcaaagtacagaaggttctggagcgagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacggaagcactaaaggcaatggagaaagtagcgagccacatcaatgagatgcagaagatctatgaggattatgggaccgtgtttgaccagctagtagctgagcagagcggaacagagaaggaggtaacagaactttcgatgggagagcttctgatgcactctacggtttcctggttgaatccatttctgtctctaggaaaagctagaaaggaccttgagctcacagtatttgtttttaagagagccgtcatactggtttataaagaaaactgcaaactgaaaaagaaattgccctcgaattcccggcctgcacacaactctactgacttggacccatttaaattccgctggttgatccccatctccgcgcttcaagtcagactggggaatccagcagggacagaaaataattccatatgggaactgatccatacgaagtcagaaatagaaggacggccagaaaccatctttcagttgtgttgcagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaaaactgttcattcctgggttttgtgcagtatacattttcccacaaaatggttgtaaagatttaagttattttaatttattgtggatcagaaacctagatgaaactggtcagaatctgtaaattacttagtttatatccactttgagcaggtatcaaatgatttaggatccttaaaattacattctaataattaagttatgtggaaaaagtaaggctggggaagtcgtgattaatagttttcaaagggccattttttaaaatcctctgggcattttctttcagctgtttgttagtttttgctttatttaaagcatatttaagttattttaatgtggtttaggggcaaaatgtgcagatacttcatttttgtaagatagattgtaatagatgctgtttatactaaacatgtcataactatctatacagtatatattaaaagaaagcttgtactgtatcttatttgatgatatttattttctctgccaagctgtatagtaaaaggaaaataagtcaca

SEQ ID NO: 189792 - DNA, 642 bp, Homo sapiens
  Payload ID: 17482
  Gene Symbol: TIAM2
  Gene Name: T-cell lymphoma invasion and metastasis 2
  ENST ID: ENST00000538270
  CDS Start-End: 387-642
gcgttttatgagccatatggaagtctgaagagctgctcagctctgacagctgtttaaattatctgtgacactgcatcccaccattagcagggatgatggattgttgacagtctccatcagaaaaggctggagtcccagtccgtggaggagcacttacagggtctttcctaagtgctgaggctctgtgtatgaatgacaaggataccttcagccagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtct

SEQ ID NO: 189793 - DNA, 877 bp, Homo sapiens
  Payload ID: 17482
  Gene Symbol: TIAM2
  Gene Name: T-cell lymphoma invasion and metastasis 2
  ENST ID: ENST00000535583
  CDS Start-End: 291-877
attccccttcagttgctccatctgggcagccagctcagggcctcagtccagagacaaagcagaggcagacgattctagttttctttgctgtaaatgccacactacatggaactagagaatttgggaatctgactcatccaatcaagcccaggctaaaggcaaatgaagaaaaggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtctccagaggtgttgcctactccacgcacaggacaaatgccccagggaaggatttccagggcatcagtgctgctttctcaactgagaatggcttccactctgttggccacgagctggcagataaccacatcacctccagagactgcaacggacaccttctcaactgctacgggaggaatgagagcattgcctccaccccaccgggcgaagaccgcaagagcccccgagtgctcatcaaaacgctggggaagctggatgggtgtttaagggtcgagttccacaatggtggcaaccccagcaaagtgcctgcagaggactgcagtgagccggtgca

SEQ ID NO: 189794 - DNA, 550 bp, Homo sapiens
  Payload ID: 17482
  Gene Symbol: TIAM2
  Gene Name: T-cell lymphoma invasion and metastasis 2
  ENST ID: ENST00000535231
  CDS Start-End: 390-550
agaaaaggctggagtcccagtccgtggaggagcacttacagggtctttcctaagtgctgatggcaaagaattagaaactaagtggatgctttcgacagaggaacagttggataagatgtcacacgtccatgccttggatttctgcacttgacctggaaggattcccatgagaaaagaaaagggctctgtgtatgaatgacaaggataccttcagccagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcagg

SEQ ID NO: 189795 - DNA, 506 bp, Homo sapiens
  Payload ID: 17482
  Gene Symbol: TIAM2
  Gene Name: T-cell lymphoma invasion and metastasis 2
  ENST ID: ENST00000545347
  CDS Start-End: 348-506
acagcgcgcgtccaagtggagaacaaagtgacccccagaacttctccaactcctcccggcgttcccgcgagggccacgcgccgagggtagcggagggcggcgcgcgaccggccccaccgagcccggcgcgcgacccgagggctctgtgtatgaatgacaaggataccttcagccagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagca

SEQ ID NO: 189796 - DNA, 575 bp, Homo sapiens
  Payload ID: 17482
  Gene Symbol: TIAM2
  Gene Name: T-cell lymphoma invasion and metastasis 2
  ENST ID: ENST00000543712
  CDS Start-End: 1-194
tgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatgagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggatttgagctgcctctttgaattatacttggagccacttcagaatgagacctttcttacccaagatgagatggagtcactttttggaagtttgccagagatgcttgagtttcagaaggtgtttctggagaccctggaggatgggatttcagcatcatctgactttaacaccctagaaaccccctcacagtttagaaaattactgttttc

SEQ ID NO: 189797 - DNA, 2677 bp, Homo sapiens
  Payload ID: 17483
  Gene Symbol: TCIRG1
  Gene Name: T-cell, immune regulator 1, ATPase, H+ transporting, lysosomal V0 subunit A3
  Uniprot ID: Q13488
  ENST ID: ENST00000265686
  CDS Start-End: 109-2601
gcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaactttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctgttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 189798 - DNA, 848 bp, Homo sapiens
  Payload ID: 17483
  Gene Symbol: TCIRG1
  Gene Name: T-cell, immune regulator 1, ATPase, H+ transporting, lysosomal V0 subunit A3
  ENST ID: ENST00000534673
  CDS Start-End: 96-620
ccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaaggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcagg

SEQ ID NO: 189799 - DNA, 868 bp, Homo sapiens
  Payload ID: 17483
  Gene Symbol: TCIRG1
  Gene Name: T-cell, immune regulator 1, ATPase, H+ transporting, lysosomal V0 subunit A3
  ENST ID: ENST00000529364
  CDS Start-End: 1-868
cagctttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgcttccagggcatcgtggatgcctacggcgtgggccgctaccaggaggtcaaccccgctccctacaccatcatcaccttccccttcctgtttgctgtgatgttcggggatgtgggccacgggctgctcatgttcctgttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctgg

SEQ ID NO: 189800 - DNA, 940 bp, Homo sapiens
  Payload ID: 17483
  Gene Symbol: TCIRG1
  Gene Name: T-cell, immune regulator 1, ATPase, H+ transporting, lysosomal V0 subunit A3
  ENST ID: ENST00000524598
  CDS Start-End: 43-940
cagccagcagcggaggcgcggcgcgcagcacacccggggaccatgggctccatgttccggagcgaggaggtggccctggtccagctctttctgcccacagcggctgcctacacctgcctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaactttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcacca

SEQ ID NO: 189801 - DNA, 220 bp, Homo sapiens
  Payload ID: 17483
  Gene Symbol: TCIRG1
  Gene Name: T-cell, immune regulator 1, ATPase, H+ transporting, lysosomal V0 subunit A3
  ENST ID: ENST00000530063
  CDS Start-End: 1-186
gatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccggtggaattccagaacaagttctactcaggcacgggctacaagctgagtcccttcaccttcgctgccacagatgactaggg

SEQ ID NO: 189802 - DNA, 2457 bp, Homo sapiens
  Payload ID: 17483
  Gene Symbol: TCIRG1
  Gene Name: T-cell, immune regulator 1, ATPase, H+ transporting, lysosomal V0 subunit A3
  Uniprot ID: Q13488
  ENST ID: ENST00000532635
  CDS Start-End: 537-2381
ggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctgttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 189803 - DNA, 842 bp, Homo sapiens
  Payload ID: 17483
  Gene Symbol: TCIRG1
  Gene Name: T-cell, immune regulator 1, ATPase, H+ transporting, lysosomal V0 subunit A3
  ENST ID: ENST00000529657
  CDS Start-End: 190-842
gcagcacacccggggttgttcccccaccccctgggaagtgctggaaggagcccggccctcgagccctcggcatagtggctgtgggagccctgatggccctgagccaggggtgacccctccccagatccccagagctgattccccacacctccttatttggccagcacagccccaaagggagccaggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaactttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgac

SEQ ID NO: 189804 - DNA, 755 bp, Homo sapiens
  Payload ID: 17483
  Gene Symbol: TCIRG1
  Gene Name: T-cell, immune regulator 1, ATPase, H+ transporting, lysosomal V0 subunit A3
  ENST ID: ENST00000528981
  CDS Start-End: 1-314
tggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgatggggaaatggaggctcagagaggtgaagtggctgggccaaggtcacacagctcctaagtgctccctacaccatcatcaccttccccttcctgtttgctgtgatgttcggggatgtgggccacgggctgctcatgttcctgttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaaga

SEQ ID NO: 189805 - DNA, 774 bp, Homo sapiens
  Payload ID: 17484
  Gene Symbol: TFPT
  Gene Name: TCF3 (E2A) fusion partner (in childhood Leukemia)
  ENST ID: ENST00000391757
  CDS Start-End: 20-601
gcttccggaggtcgcggagatggaattggagcagagagaagggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggtgaacgagcgggtcctgaacaggctccatcaggtgcagaggataactcggaggctgcagcaggaacggaggttcctcatgagagtgctggactcctacggggatgactaccgggccagccagttcaccattgtgctggaggcaatgcggagaatgagcctccagagaaagagacactgtccccgcccagaaggactcctgcacccccagaacccggcagcccagcccccggtgaggggcccagtgggcggaagaggcggcgagtgccacgggatggacgccgagcaggaaatgcgctgactccagagctggccccggtgcagattaaggttgaggaagactttggctttgaagcagatgaggccctggattccagttgggtttctcggggtccagacaaactgctgccctacccgaccctggccagcccagcctctgactgacgcatgcccaataaactgaccccacactca

SEQ ID NO: 189806 - DNA, 804 bp, Homo sapiens
  Payload ID: 17484
  Gene Symbol: TFPT
  Gene Name: TCF3 (E2A) fusion partner (in childhood Leukemia)
  ENST ID: ENST00000391758
  CDS Start-End: 40-774
aggggtttggactgctggatctgacagactaggaggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggtgaacgagcgggtcctgaacaggctccatcaggtgcagaggataactcggaggctgcagcaggaacggaggttcctcatgagagtgctggactcctacggggatgactaccgggccagccagttcaccattgtgctggaggatgagggcagccagggcacggatgcccccaccccaggcaatgcggagaatgagcctccagagaaagagacactgtccccgcccagaaggactcctgcacccccagaacccggcagcccagcccccggtgaggggcccagtgggcggaagaggcggcgagtgccacgggatggacgccgagcaggaaatgcgctgactccagagctggccccggtgcagattaaggttgaggaagactttggctttgaagcagatgaggccctggattccagttgggtttctcggggtccagacaaactgctgccctacccgaccctggccagcccagcctctgactgacgcatgcccaataaactgaccccacactca

SEQ ID NO: 189807 - DNA, 1205 bp, Homo sapiens
  Payload ID: 17484
  Gene Symbol: TFPT
  Gene Name: TCF3 (E2A) fusion partner (in childhood Leukemia)
  Uniprot ID: P0C1Z6
  ENST ID: ENST00000391759
  CDS Start-End: 407-1168
atttgaaacaacaactttattagcacctggcactaggcggagagaggcggtaagccgcgaggaggaaagggactcacgtcccgctgtggaccgatcctgctaagcagagaatcgctgtggccggacgacggggcgtcgagacaagaagaaagacgttggcaactcagaggactggttgcggcgttagacaagaaagcaaggcctttaagcagggattcggggtggacgtgggggtgggccgaagcgaagccggaaacaggaaactacaactcccacaaggcctagggccacgtcccgccgtcctcggctgctgagcctgatgggacaagtagttttgcgaacggcttaacctacagattgaagaggtcggaagctctgaggcccggggcttccggaggtcgcggagatggaattggagcagagagaagggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggtgaacgagcgggtcctgaacaggctccatcaggtgcagaggataactcggaggctgcagcaggaacggaggttcctcatgagagtgctggactcctacggggatgactaccgggccagccagttcaccattgtgctggaggatgagggcagccagggcacggatgcccccaccccaggcaatgcggagaatgagcctccagagaaagagacactgtccccgcccagaaggactcctgcacccccagaacccggcagcccagcccccggtgaggggcccagtgggcggaagaggcggcgagtgccacgggatggacgccgagcaggaaatgcgctgactccagagctggccccggtgcagattaaggttgaggaagactttggctttgaagcagatgaggccctggattccagttgggtttctcggggtccagacaaactgctgccctacccgaccctggccagcccagcctctgactgacgcatgcccaataaactgaccccacactcaccccggc

SEQ ID NO: 189808 - DNA, 737 bp, Homo sapiens
  Payload ID: 17484
  Gene Symbol: TFPT
  Gene Name: TCF3 (E2A) fusion partner (in childhood Leukemia)
  ENST ID: ENST00000420715
  CDS Start-End: 17-334
tccggaggtcgcggagatggaattggagcagagagaagggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggttcctcatgagagtgctggactcctacggggatgactaccgggccagccagttcaccattgtgctggaggatgagggcagccagggcacggatgcccccaccccaggcaatgcggagaatgagcctccagagaaagagacactgtccccgcccagaaggactcctgcacccccagaacccggcagcccagcccccggtgaggggcccagtgggcggaagaggcggcgagtgccacgggatggacgccgagcaggaaatgcgctgactccagagctggccccggtgcagattaaggttgaggaagactttggctttgaagcagatgaggccctggattccagttgggtttctcggggtccagacaaactgctgccctacccgaccctggccagcccagcctctgactgacgcatgcccaataaactgaccccacactca

SEQ ID NO: 189809 - DNA, 1205 bp, Homo sapiens; identical to SEQ ID NO: 189807
  Payload ID: 17484
  Gene Symbol: TFPT
  Gene Name: TCF3 (E2A) fusion partner (in childhood Leukemia)
  ENST ID: ENST00000617348
  CDS Start-End: 407-1168

SEQ ID NO: 189810 - DNA, 1205 bp, Homo sapiens; identical to SEQ ID NO: 189807
  Payload ID: 17484
  Gene Symbol: TFPT
  Gene Name: TCF3 (E2A) fusion partner (in childhood Leukemia)
  Uniprot ID: P0C1Z6
  ENST ID: ENST00000616798
  CDS Start-End: 407-1168

SEQ ID NO: 189811 - DNA, 1205 bp, Homo sapiens; identical to SEQ ID NO: 189807
  Payload ID: 17484
  Gene Symbol: TFPT
  Gene Name: TCF3 (E2A) fusion partner (in childhood Leukemia)
  ENST ID: ENST00000615534
  CDS Start-End: 407-1168

SEQ ID NO: 189812 - DNA, 1205 bp, Homo sapiens; identical to SEQ ID NO: 189807
  Payload ID: 17484
  Gene Symbol: TFPT
  Gene Name: TCF3 (E2A) fusion partner (in childhood Leukemia)
  ENST ID: ENST00000611514
  CDS Start-End: 407-1168

SEQ ID NO: 189813 - DNA, 1205 bp, Homo sapiens; identical to SEQ ID NO: 189807
  Payload ID: 17484
  Gene Symbol: TFPT
  Gene Name: TCF3 (E2A) fusion partner (in childhood Leukemia)
  ENST ID: ENST00000611935
  CDS Start-End: 407-1168

SEQ ID NO: 189814 - DNA, 737 bp, Homo sapiens; identical to SEQ ID NO: 189808
  Payload ID: 17484
  Gene Symbol: TFPT
  Gene Name: TCF3 (E2A) fusion partner (in childhood Leukemia)
  ENST ID: ENST00000610802
  CDS Start-End: 17-334

SEQ ID NO: 189815 - DNA, 1205 bp, Homo sapiens; identical to SEQ ID NO: 189807
  Payload ID: 17484
  Gene Symbol: TFPT
  Gene Name: TCF3 (E2A) fusion partner (in childhood Leukemia)
  ENST ID: ENST00000614788
  CDS Start-End: 407-1168

SEQ ID NO: 189816 - DNA, 775 bp, Homo sapiens
  Payload ID: 17484
  Gene Symbol: TFPT
  Gene Name: TCF3 (E2A) fusion partner (in childhood Leukemia)
  ENST ID: ENST00000615094
  CDS Start-End: 165-602
agcgaagccggaaacaggaaactacaactcccacaaggcctagggccacgtcccgccgtcctcggctgctgagcctgatgggacaagtagttttgcgaacggcttaacctacagattgaagaggtcggaagctctgaggcccggggcttccggaggtcgcggagatggaattggagcagagagaagggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccagcgggaattaaatcgcagaaagtaccaggcactaggtcggcgctgccgggagatcgagcaggtgaacgagcgggtcctgaacaggctccatcaggtgcagaggataactcggaggctgcagcaggaacggaggttcctcatgagagtgctggactcctacggggatgactaccgggccagccagttcaccattgtgctggagcaggaaatgcgctgactccagagctggccccggtgcagattaaggttgaggaagactttggctttgaagcagatgaggccctggattccagttgggtttctcggggtccagacaaactgctgccctacccgaccctggccagcccagcctctgactgacgcatgcccaataaactgaccccacactca

SEQ ID NO: 189817 - DNA, 1205 bp, Homo sapiens; identical to SEQ ID NO: 189807
  Payload ID: 17484
  Gene Symbol: TFPT
  Gene Name: TCF3 (E2A) fusion partner (in childhood Leukemia)
  ENST ID: ENST00000616277
  CDS Start-End: 407-1168

SEQ ID NO: 189818 - DNA, 774 bp, Homo sapiens; identical to SEQ ID NO: 189805
  Payload ID: 17484
  Gene Symbol: TFPT
  Gene Name: TCF3 (E2A) fusion partner (in childhood Leukemia)
  ENST ID: ENST00000621091
  CDS Start-End: 20-601

SEQ ID NO: 189819 - DNA, 1205 bp, Homo sapiens; identical to SEQ ID NO: 189807
  Payload ID: 17484
  Gene Symbol: TFPT
  Gene Name: TCF3 (E2A) fusion partner (in childhood Leukemia)
  ENST ID: ENST00000615620
  CDS Start-End: 407-1168

SEQ ID NO: 189820 - DNA, 804 bp, Homo sapiens; identical to SEQ ID NO: 189806
  Payload ID: 17484
  Gene Symbol: TFPT
  Gene Name: TCF3 (E2A) fusion partner (in childhood Leukemia)
  ENST ID: ENST00000611344
  CDS Start-End: 40-774

SEQ ID NO: 189821 - DNA, 1205 bp, Homo sapiens; identical to SEQ ID NO: 189807
  Payload ID: 17484
  Gene Symbol: TFPT
  Gene Name: TCF3 (E2A) fusion partner (in childhood Leukemia)
  ENST ID: ENST00000619581
  CDS Start-End: 407-1168

SEQ ID NO: 189822 - DNA, 2499 bp, Homo sapiens
  Payload ID: 17485
  Gene Symbol: TCP1
  Gene Name: t-complex 1
  Uniprot ID: P17987
  ENST ID: ENST00000321394
  CDS Start-End: 282-1952
aaaaatgccgaccccgccccttccccggagcctcacttccgtcacagtcctgtttctctccctgttgtccctgcctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctaacgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattca

SEQ ID NO: 189823 - DNA, 1878 bp, Homo sapiens
  Payload ID: 17485
  Gene Symbol: TCP1
  Gene Name: t-complex 1
  ENST ID: ENST00000392168
  CDS Start-End: 615-1820
gtcctgtttctctccctgttgtccctgcctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacggatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttg

SEQ ID NO: 189824 - DNA, 1671 bp, Homo sapiens
  Payload ID: 17485
  Gene Symbol: TCP1
  Gene Name: t-complex 1
  ENST ID: ENST00000420894
  CDS Start-End: 105-1406
tccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgag

SEQ ID NO: 189825 - DNA, 691 bp, Homo sapiens
  Payload ID: 17485
  Gene Symbol: TCP1
  Gene Name: t-complex 1
  ENST ID: ENST00000537390
  CDS Start-End: 358-691
tttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgataaagagagttttaatgagcaaaaaacttgcagaatctgaaggaaaaggctggtatagctgtacgaagtggcagagcatgaaattgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatg

SEQ ID NO: 189826 - DNA, 1403 bp, Homo sapiens
  Payload ID: 17485
  Gene Symbol: TCP1
  Gene Name: t-complex 1
  ENST ID: ENST00000544255
  CDS Start-End: 324-1322
tcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacggatgtaaccattactaacgatggtgcaaccatcctgaagttactggaggtagaacatcctgcagctaaagttctttgtgagctggctgatctgcaagacaaagaagttggagatggaactacttcagtggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggggtctcgggaacagcttgcgattgcagagtttgcaagatcacttcttgttattcccaatacactagcagttaatgctgcccaggactccacagatctggttgcaaaattaagagcttttcataatgaggcccaggttaacccagaacgtaaaaatctaaaatggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagt

SEQ ID NO: 189827 - DNA, 706 bp, Homo sapiens
  Payload ID: 17485
  Gene Symbol: TCP1
  Gene Name: t-complex 1
  ENST ID: ENST00000539948
  CDS Start-End: 299-706
tttgtttttattttttgtagaaatgggtttcgctatgttgcccaaaggggtctcaaactcctggcatcaagcgatcctcctgcctcggcctcgcagtgttgggattacacctgtgagccacagtgtctggccccatttacactcttagtaggtggtttttaaataattaacacagatttgtagatttgggaaatacgggggctgttggatgtcatttacctttaggctgaaattactgtctttcagagttgtggcttatcctcatttcttttttatttttaattgattgtctacagttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttcc

SEQ ID NO: 189828 - DNA, 918 bp, Homo sapiens
  Payload ID: 17485
  Gene Symbol: TCP1
  Gene Name: t-complex 1
  ENST ID: ENST00000538530
  CDS Start-End: 117-314
gctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggttggttcatattttttcctgcgaatttcttaggatgtaaccattactaacgatggtgcaaccatcctgaagttactggaggtagaacatcctgcagctaaagttctttgtgagctggctgatctgcaagacaaagaagttggagatggaactacttcagtgaccagtgaatgttttctcaacaggttattattgcagcagaactcctaaaaaatgcagatgaattagtcaaacagaaaattcatcccacatcagttattagtggctatcgacttgcttgcaaggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctattaaatacacagacataagaggccagccacgctatccagtcaactctgttaatattttgaaagcccatgggagaagtcaaatggagagtatgctcatcagtggctatgcactcaactgtgtggtgggatcccagggcatgcccaagagaatcgtaaatgcaaaaattgcttgccttgacttcagcctgcaaaaaacaaaaatgaagcttggtg

SEQ ID NO: 189829 - DNA, 780 bp, Homo sapiens
  Payload ID: 17485
  Gene Symbol: TCP1
  Gene Name: t-complex 1
  ENST ID: ENST00000539756
  CDS Start-End: 118-780
cgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacggcatgcccaagagaatcgtaaatgcaaaaattgcttgccttgacttcagcctgcaaaaaacaaaaatgaagcttggtgtacaggtggtcattacagaccctgaaaaactggaccaaattagacagagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggagcaactattctgtcaaccctggccaatttggaaggtgaagaaacttttgaagctgcaatgttgggacaggcagaagaagtggtacaggagagaatttgtgatgatgagctgatcttaatcaaaaatactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatatacctt

SEQ ID NO: 189830 - DNA, 557 bp, Homo sapiens
  Payload ID: 17485
  Gene Symbol: TCP1
  Gene Name: t-complex 1
  ENST ID: ENST00000538128
  CDS Start-End: 381-557
tttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacggatgtaaccattactaacgatggtgcaaccatcctgaagttactggaggtagaacatcctgcagctaaagttctttgtgagctggctgatctgcaagacaaagaagttggagatggaactacttcagtgggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgctgtacttgctatt

SEQ ID NO: 189831 - DNA, 535 bp, Homo sapiens
  Payload ID: 17485
  Gene Symbol: TCP1
  Gene Name: t-complex 1
  ENST ID: ENST00000536394
  CDS Start-End: 262-535
actcgagtgcattgaccccaggagacggcagcgctaacttagcagagcgtttgctgtcaggcctttggatacctacagagcttactgtttcttgatagattcctaatttttttcgtaaacaaatctgaaagtcaccaccttccccgttgactaccgatttctctcctcacagataaagagagttttaatgagcaaaaaacttgcagaatctgaaggaaaaggctggtatagctgtacgaagtggcagagcatgaaattgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtggttattattgcagcagaactcctaaaaaatgcagatgaattagtcaaacagaaaattcatc

SEQ ID NO: 189832 - DNA, 561 bp, Homo sapiens
  Payload ID: 17485
  Gene Symbol: TCP1
  Gene Name: t-complex 1
  ENST ID: ENST00000543517
  CDS Start-End: 135-437
agtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacgttatggctgcagcttcgattgccaatattgtaaaaagttctcttggtccagttggcttggataaaatgttggtggatgatattggtgatgtaaccattactaacgatggtgcaaccatcctgaagttactggaggtagaacatcctgcagctaaagttctttgtgagctggctgatctgcaagacaaagaagttggagatggaactacttcagtgggaagcagtgcgttatatcaatgaaaacctaattgttaacacagatgaactgggaagagattgcctgattaatgctgctaagacatccatgtcttccaaaatcattggaataaatggtgatttctttgctaacatggtagtagatgct

SEQ ID NO: 189833 - DNA, 2250 bp, Homo sapiens
  Payload ID: 17486
  Gene Symbol: TCP10
  Gene Name: t-complex 10
  Uniprot ID: Q12799
  ENST ID: ENST00000366827
  CDS Start-End: 213-1109
aagacagaaagtccgttggaaccgtcggctgctctctggtctctggagatgaggcgggaggacttggggacagctgtggggacacggcccagatgctctggtcccagcagaagtgactggcggggaccaggatgctggagggtcagctcgaggccgggtagcccaaggagggcacccacccagaagacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggcattggaacctgcttttggaaaaatttcacatctgtcagctgatgaagacacaacgcccaaatacgctggccgcaagagtcagagtgccactctcctgggacaaagatggtcatctaaccacttagctcctccaaagccaatgagtttaaagacagaaagaattaactcggggaaaacaccaccacaggaagatagagagaaaagtcctcccgggagacgtcaagacagaagtccagcacccactggaaggccgactcccggtgcagaaagacggggggtgtctgaagacggaaagattatgcatccatcttcccgaagtccgcaaaactccggtggcagaaaatcaccagtgcaggcttcccaggccaccacgctgcaggagcagacggcagcagccagaggagctgacagaagctcatcagtcttagggagttctgaaggcggatttctcagccgcgttcaagctgacgagttcgccagttctgccccagacagtgcagagcggcagaaaaattctaccccaatggctccaaagaaatcgtgtttcccgacgggacggtggaacatctcaaggatggacaggaagagaccttatttcctgatgggacaatcgtaagggtggaaaggaacggcgacaaaaccattgtgctcagcaacgggcagaaagaaatccacacagcccggttcaagaggagggagtacccggatggcaccgtcaagactgtgtattgcagcggctgtcaggaaaccaagtatgcctccgggagggttaagatcaaagatgaagctggaaatgtcgtcctggacgagaagcagatgagccctcaacacgcagcatcacatgggaaatgccaattgcagatttttgctaaaacagacaaaaactaataacatattagctgccctaaatgatcttggagagccaccaaaactttaggactacccaagtcatctagaaattgcaaaggaaaagacattctctcccctatttaggaaacttggttagagcagcacacgtcggagaacaggaggctcacaaaagaacgattttcagtgcccccagcaaggctgcaccctccttgatcatcacaggggccatttctgccttgtgatggacccaggaggtctctgcagagcaagtgccgttggaccagctgattcacaaagtgctgagcccctcttccccgtgtggcccaccccaggcacggctcattcctccagaattatagaagctcagcctggcctgctcccctctggtcaccgacacccctgtcctcgctgggacaagagggagacaattctagtcactacaaggacacccaaggggtgtctgagtcagggctccaatagtgcagttatcgtggcctctcgcagcccggggagcacgtcgcctcttgaaactcgagatttcttaaatcccaatataaaaatgataaccagttacttacttcttttgttgttttgcaggccacctagaaatacaaaatgccaattcacctaatttttatactgaaatgtagatgcccccaacatgattttggaaagatataatttcttgaaaatcttatcagaagatgcatagttaatttttttccattatgtactcatgtttttatgaaatacaataccatattttagggccagggattattttaaccttaaaattgtgcatgcatcattgtagccctcaatatttggtaatgctatttaaagtgactcaagaagcatgtgctatctggctttgaaggaaaaaaaaa

SEQ ID NO: 189834 - DNA, 2141 bp, Homo sapiens
  Payload ID: 17486
  Gene Symbol: TCP10
  Gene Name: t-complex 10
  ENST ID: ENST00000397829
  CDS Start-End: 169-1149
ggagatgaggcgggaggacttggggacagctgtggggacacggcccagatgctctggtcccagcagaagtgactggcggggaccaggatgctggagggtcagctcgaggccgggtagcccaaggagggcacccacccagaagacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggcattggaacctgcttttggaaaaatttcacatctgtcagctgatgaagacacaacgcccaaatacgctggccgcaagagtcagagtgccactctcctgggacaaagatggtcatctaaccacttagctcctccaaagccaatgagtttaaagacagaaagaattaactcggggaaaacaccaccacaggaagatagagagaaaagtcctcccgggagacgtcaagacagaagtccagcacccactggaaggccgactcccggtgcagaaagacggggggtgtctgaagacggaaagattatgcatccatcttcccgaagtccgcaaaactccggtggcagaaaatcaccagtgcaggcttcccaggccaccacgctgcaggagcagacggcagcagccagaggagctgacagaagctcatcagtcttagggagttctgaaggcggatttctcagccgcgttcaagctgacgagttcgccagttctgccccagacagtgcagagcggcagaatcttcctgtaaacccaccatcttccctggaaatagcacaggccatggacactaagatgaaaaaggaggaagtacaggaagaaaaacgacatccaaagggcaaggcagatgactgccggcggtccggtttcccgagtgaatttccaggagctctgcacgccgctccctccagacaggacatggggccctgacctggaggccaggcgtttctagcattgttgactgccagtttattcccagtaaataaagcaatacgcttttcaggaggaagatttgttttaaatacttaaaaaaaaacccaaaactatagcctcaaatatcttccagccaccacattttagcccttgaggagagctcagttccggaaggacgcgtcaaggtggcggtggtcggcattgactcaggaaggggtgggaagaggcacctgctgcggctgcggctgcggctacagtgttttgtgagctccgaggagacccagtcctgcctggggcagcacatcatcgctgcttcttcagctcaacagttcgttcatctcacgcctcttgctggcctgttagaaactgggagtcggcctcaggctagctttgctgagggaactctgcctcagtaaaagcgaattcatgtcttgcaagcgggtaaagcatttggataaatgaacaacagggaatgctacttgcagtaacagtttgaattcactgaaatgcttttgtctttagcgcagtggttgtagtggtttgtcaggggagaaggaaacccacatcatttgagcacctgaccttgccatccccgtaggcaggtccatgagacataagtgatgctcctccttggctaagtgcatggaggaaccaatcgctgaagctcatgaaaccacgaagatgaggacacaagaactaggtaacgcgctgtgccctctgctagcgcgatccttcctttctccccacaaccagcggtcacccacctctgcctgcccctatgtctctggctcccccaccctccctcccaggtcttcagcactttcctcttctcgtgactcatcttgcatctacttcttgtgtatcttgcattggatatgccaaagttctttccttttttgtgttttctttcttttaataatataaactccaaaatagattgtttgattcttttcatgtggaacatttaaaatattatttgtgctttatta

SEQ ID NO: 189835 - DNA, 374 bp, Homo sapiens
  Payload ID: 17486
  Gene Symbol: TCP10
  Gene Name: t-complex 10
  ENST ID: ENST00000485157
  CDS Start-End: 88-374
accaggatgctggagggtcagctcgaggccgggtagcccaaggagggcacccacccagaagacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggtaccaaa

SEQ ID NO: 189836 - DNA, 3219 bp, Homo sapiens
  Payload ID: 17486
  Gene Symbol: TCP10
  Gene Name: t-complex 10
  ENST ID: ENST00000460930
  CDS Start-End: 1-624
gggacacggcccagatgctctggtcccagcagaagtgactggcggggaccaggtgaggtgatgaggtctgttagtggggctgagggaaggggtcttccccagactgagggggtcacaagtttggggccgaggacactggggtatcccctcggaggagcgggaaagaagaagctttctcagggctgtgaggaccgcggacccttgcccacttccacagaaactgtcccaatccccgcggggaaggaacagccagggatccggttactggcattggaacctgcttttggaaaaatttcacatctgtcagctgatgaagacacaacgcccaaatacgctggccgcaagagtcagagtgccactctcctgggacaaagatggtcatctaaccacttagctcctccaaagccaatgagtttaaagacagaaagaattaactcggggaaaacaccaccacaggaagatagagagaaaagtcctcccgggagacgtcaagacagaagtccagcacccactggaaggccgactcccggtgcagaaagacggggggtgtctgaagacggaaaggtgacctcggaaacctgggtcactctacactggcagcatggaaaattcagattcagatgaagttccacttaggtctcataagagtactcaatttgttattcgaaatagacctagtaatttattaacctaattatgtttctatagataaaactttgaatttctgcagacatgtctttaatgctataaaagcaaataaattgaattgggttttaaaaagcaaacaacttgaattgggttttaaaaatcaattactttcccgagctccgtaattggtatatttctgcagagtctttaaaagaattgatctaccttgtagtgctgagctcagggctgttgggtgagccctggggtcttgctggaaattgtggatggctgaagatggcttcgtgctcccagcctttgggctcgaggcattgccggctgcagggaccttgtgacaaggggggcctctgactgtctttgccccagattatgcatccatcttcccgaagtccgcaaaactccggtggcagaaaatcaccagtgcaggcttcccaggccaccacgctgcaggagcagacggcagcagccagaggagctggtgagcagggtcgagggctcctaactgtttccatgcttcctgtaaagtggggggctttcttgtggatacgcgtgagcagaacatcttactacggcaaggacatgtccttcatggagctgcctaatttctgaccacttttgtccgattccctggttgggtcctcacctgggagtcttgccgacacccctagccctccaccccacacacagcccacatgccggtctccaggggccgtggctggagattccgaatcctaccggccacttcccctgagtacactcccagctgaaggcgtctggctgggcctgggcggactcgggggctttgttcccttttctccgtttgcccgcccatggcgttgctgccacgctgatggagcgccctctcatccggcacctgcccggcctctttcctgagcccagctctgtccatgcagatgtgggtgctttctgcattgggggtcccaccgggaggagccaacagtacccctggtagagttgggaaagaactccttcctcacgttactgccagaaaatgaccatagcagcttcacaaaccccgcaggaacctgtcttcctaaagaaatggagcccatgaggtggccgagcctcaggtgtggtccttatgcacagcacagcccaagcctgtgggcacaactcgccctgggctgcctggcacctggactctttcctatcctcggcccaggcctgtgtggccctgtagggccaaacccgacactgtcttcctcctgggtccgctccctgggcctcctgcaccccagactgcttcatggcctctgcagggagcttcacagaggtgagactggtgccatctgtctgcttcagaccaccccaggctctgcgtaccctcacagtcccctctgcgctcctctacggggtggggaagcccttcccatcaggtcagcaccagcctggccaccttgtttctgctgccccctcctcttcaggcccccagaccagactttagttacttgctgctgccgggcagaactggaggccttgtcttgcacaacctccacaacctccaggcatcatctcagctgacagtgacgccatcctggggaagaccccccggatcccgggctctcctggaagcctgtgatgctccttcaccacagcccctgtcccttcataggtcccataagccagtggtgcagggatctggcctttctctcctgtgtctgcctcctgcagaaccatgagcagcttcagggccgaggcagtgcctttccatccgtgaatctcctgagccatcagaatactcgagagagagtgatgcccaagaaatactgactgagtgtattcatgaaagaattaatgttcttacaggatcacttgttgttgaactgacctgacatgtgtatagtgatctcatgaacaagagggaagctgtgcatccattcacttcaattggatttagcaatcgcagtaggataatgatatttccacaatgtatatgctctgtccctttaaatttaactttttgctttttagacagaagctcatcagtcttagggagttctgaaggcggatttctcagccgcgttcaagctgacgagttcgccagttctgccccagacagtgcagagcggcaggtaggtggctgagtggcttctgtgagggcggcccacccggttcccctcagggagacctgagaaggtgaccttttcgtcctggggaagtgagattcggagccggtgtcatgagatggttgcatcttcccatcttctcaacaagaacagaaaattaagatgattccaaatgtctctttatttcctgaagttcagcctttcaaacagagacttttttttatagatttaagttggttgcatttagcacaaacaagattaatgttttttatgacttaagagttcccctagtcagagtttcattttttatcattttgatttacagttctcagttgacattaatagactcgaaggcaagaatagcaaacatacttctaagccctagctaggggccgacttgtaacatgctatattttacaaaaaaaaaaagtcaataaaataaaattattttctctacgccaggaaa

SEQ ID NO: 189837 - DNA, 646 bp, Homo sapiens
  Payload ID: 17486
  Gene Symbol: TCP10
  Gene Name: t-complex 10
  ENST ID: ENST00000476779
  CDS Start-End: 152-475
agtgactggcggggaccagaaactgtcccaatccccgcggggaaggaacagccagggatccggttactggatgctggagggtcagctcgaggccgggtagcccaaggagggcacccacccagaagacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggtaccaaaggcgcatttgtgtttttgtatcatttgcgtcgtgtaaatatagcgtccccgtaaagatgtgggctttgttgctgggtgacgtggtatctctcacgttccaggtggtgggagggcttgctatctttccatcagctccatttcccacaagtaaagattaaagaactggatacatcaggcatctcacctgacactccagcagacagaagca

SEQ ID NO: 189838 - DNA, 2182 bp, Homo sapiens
  Payload ID: 17486
  Gene Symbol: TCP10
  Gene Name: t-complex 10
  ENST ID: ENST00000617120
  CDS Start-End: 132-1190
aagacagaaagtccgttggaaccgtcggctgctctctggtctctggagatgaggcgggaggacttggggacagctgtggggacacggcccagatgctctggtcccagcagaagtgactggcggggaccaggatgctggagggtcagctcgaggccgggcccaaggagggcacccacccagaagacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggcattggaacctgcttttggaaaaatttcacatctgtcagctgatgaagacacaacgcccaaatacgctggccgcaagagtcagagtgccactctcctgggacaaagatggtcatctaaccacttagctcctccaaagccaatgagtttaaagacagaaagaattaactcggggaaaacaccaccacaggaagatagagagaaaagtcctcccgggagacgtcaagacagaagtccagcacccactggaaggccgactcccggtgcagaaagacggggggtgtctgaagacggaaagattatgcatccatcttcccgaagtccgcaaaactccggtggcagaaaatcaccagtgcaggcttcccaggccaccacgctgcaggagcagacggcagcagccagaggagctgacagaagctcatcagtcttagggagttctgaaggcggatttctcagccgcgttcaagctgacgagttcgccagttctgccccagacagtgcagagcggcagaatcttcctgtaaacccaccatcttccctggaaatagcacaggccatggacactaagatgaaaaaggaggaagtacaggaagaaaaacgacatccaaagggcaaggcagatgactgccggcggtccggtttcccgagtgaatttccaggagctctgcacgccgctccctccagacaggacatggggccctgacctggaggccaggcgtttctagcattgttgactgccagtttattcccagtaaataaagcaatacgcttttcaggaggaagatttgttttaaatacttaaaaaaaaacccaaaactatagcctcaaatatcttccagccaccacattttagcccttgaggagagctcagttccggaaggacgcgtcaaggtggcggtggtcggcattgactcaggaaggggtgggaagaggcacctgctgcggctgcggctgcggctacagtgttttgtgagctccgaggagacccagtcctgcctggggcagcacatcatcgctgcttcttcagctcaacagttcgttcatctcacgcctcttgctggcctgttagaaactgggagtcggcctcaggctagctttgctgagggaactctgcctcagtaaaagcgaattcatgtcttgcaagcgggtaaagcatttggataaatgaacaacagggaatgctacttgcagtaacagtttgaattcactgaaatgcttttgtctttagcgcagtggttgtagtggtttgtcaggggagaaggaaacccacatcatttgagcacctgaccttgccatccccgtaggcaggtccatgagacataagtgatgctcctccttggctaagtgcatggaggaaccaatcgctgaagctcatgaaaccacgaagatgaggacacaagaactaggtaacgcgctgtgccctctgctagcgcgatccttcctttctccccacaaccagcggtcacccacctctgcctgcccctatgtctctggctcccccaccctccctcccaggtcttcagcactttcctcttctcgtgactcatcttgcatctacttcttgtgtatcttgcattggatatgccaaagttctttccttttttgtgttttctttcttttaataatataaactccaaaatagattgtttgattcttttcatgtggaacatttaaaatattatttgtgctttatta

SEQ ID NO: 189839 - DNA, 2695 bp, Homo sapiens
  Payload ID: 17487
  Gene Symbol: TCP10L
  Gene Name: t-complex 10-like
  Uniprot ID: Q8TDR4
  ENST ID: ENST00000300258
  CDS Start-End: 115-762
ggaactgtccgctgctctctggtctctggatatgaggcaggagggcttggggacaactgtggggacatggcccagatgatctgatcctggcagtagtgactgttggggaccaggatgctggcaggtcaactcgaggccagggaccccaaagagggcacccacccagaggacccgtgcccaggagctggggctgtcatggagaagacagctgtggcagccgaggttctcacggaggactgcaacactggggagatgccaccattacagcagcagatcatcagactccaccaagagcttgggagacagaagtctctgtgggctgatgttcatggaaaactccggagtcatatagatgctttgagggagcagaacatggagctccgagaaaagctgagagctctgcagctgcagcggtggaaagccaggaagaaatctgcagcgtccccacacgcggggcaagaatcgcacactctggcattggaacctgcttttggaaaaatttcacctctgtcagctgatgaagagacaatacccaaatacgctggccacaagaatcagagtgccactctcctgggacaaagatcgtcatctaacaattcagctcctccaaagccaatgagtttaaagatagaaagaattagctcgtggaaaacaccaccacaggaaaatagagataaaaatctttccaggagacgtcaagacagaagagcaacacctactggaaggccaactccctgtgcagagagacgggggggtgtctgaagatggaaaggtggcctcggacacctgtgtcactctacactggccccttggaaaattcagattcagataaagttccacttaggtctaataaaagtactcaatttgttattcaaaatagacctagtaatttattaaactaattatgtttctatagataaaaacttgaagttcttcagacatgtctctaatgctataaaagcaaacaacttggattgggttttataaatcagttgctttcctgagctctgtagttggtatatttctgcagagtctttaaaaaaattaacccaccttgtagtatggagtgtcgggctgttgggtgagccctggggtcttgctggaaatcgaggatggctgaagatggctttgtgctcccagcctttgggctcaaggcattgcccgctccagggaccttgtgacaaggcgggcctgtgactgtcattgccccaggctatgcatccatcttcccgaagtctgcaaaacttgagtggcagaaaatcaccagtgcaggcttcccaggccgccatgctgcaggagcagatggcagcagccggaggagctggtgagcagagttggggactcctgtttctatgctccccgtgaaatgcggggctttctcgtggatacgcgtgagcagaacatcttactatggcaaggacatgtccttcctggagctgcctaatttgtggccactttttgtctgattccctcgttgggtcctcacctgtgagacttgccaacacccccagccctccaccccacacacagcccacatgccggtctccaggggccgtgactggagattccgaatcctagcggtcacttccctctgagcacactcccagcagaaggcgtgtggctggggctagatgcacttgggtgctttgttcccctttctccatttgccagcccatggcattgctgccaccctgatggagcgccctctcatctggcaccttcctggcctctttcccaggccccagttctgtccatgcagctgtgggtgcttcctgcattgcgggtctcacggggaggagacgagagtgcccctggttgagtcaggaaagaattctatcttcacgtcgctgccagcaaatgaccacagcagcttcacgacctctgcaggaacctatcttggtaaagaaacggggcctatgtggtggccgagcctcaggtgtggccgagcttcaggtgtggcccttatgcacagcacagcccaagcctgtgggcaccactcgccctgggctgcctggcacctggactccttcccatccttggccgaggtctgcgtggcccttcagggccgaatctgacactgtcttcctcctgagtctgccccccgggcttcctgcccacccccaggctgtttcatggcctctgcagggagcttcgtagaggtgaggctggtgccatctgtctgcttcagaccacctcaggctctgcgtgccctcacagtcccctctgcacttctctgtggggcagggaagcccttcccatcaggtctgctccagcctggctaccttgttcctgctgtcccctccccttcaggcccccggacaagacttcagtgtacttgctggtgccgggcagaatgggggaccttgcctctcacacacacctgctagtatctccgcaacctccaggcatcatctcagctgacagtgacgccatcctggggaagctcccctgactcctggctctcctggaagcctgtggtgctccttcacaatggcccgtggcccttcataggtcccgtaagccagtgtcacagggattcggcttttctcttctgtgtttgcctgctgcgggactgtgagcagcttcagggccaagacagtgcctttccatccgtgaatctcctgatccatcagaatactcgaaagagaaataccgactgagtgtattcattaaagaattaatgttccttacagga

SEQ ID NO: 189840 - DNA, 636 bp, Homo sapiens
  Payload ID: 17487
  Gene Symbol: TCP10L
  Gene Name: t-complex 10-like
  ENST ID: ENST00000582575
  CDS Start-End: 63-636
ccacagtccaaacgcccaggagcctccgccctgacctgctgccgcacgtggttgctgcagggatgctggcaggtcaactcgaggccagggaccccaaagagggcacccacccagaggacccgtgcccaggagctggggctgtcatggagaagacagctgtggcagccgaggttctcacggaggactgcaacactggggagatgccaccattacagcagcagatcatcagactccaccaagagcttgggagacagaagtctctgtgggctgatgttcatggaaaactccggagtcatatagatgctttgagggagcagaacatggagctccgagaaaagctgagagctctgcagctgcagcggtggaaagccaggaagaaatctgcagcgtccccacacgcggggcaagaatcgcacactctggcattggaacctgcttttggaaaaatttcacctctgtcagctgatgaagagacaatacccaaatacgctggccacaagaatcagagtgccactctcctgggacaaagatcgtcatctaacaattcagctcctccaaagccaatgagtttaaagatagaaagaattagctcgtggaaaacaccaccacaggaaaatagagataaaaatctttcca

SEQ ID NO: 189841 - DNA, 732 bp, Homo sapiens
  Payload ID: 17487
  Gene Symbol: TCP10L
  Gene Name: t-complex 10-like
  ENST ID: ENST00000472557
  CDS Start-End: 228-617
ggaactgtccgctgctctctggtctctggatatgaggcaggagggcttggggacaactgtggggacatggcccagatgatctgatcctggcagtagtgactgttggggaccagccattacagcagcagatcatcagactccaccaagagcttgggagacagaagtctctgtgggctgatgttcatggaaaactccggagtcatatagatgctttgagggagcagaacatggagctccgagaaaagctgagagctctgcagctgcagcggtggaaagccaggaagaaatctgcagcgtccccacacgcggggcaagaatcgcacactctggcattggaacctgcttttggaaaaatttcacctctgtcagctgatgaagagacaatacccaaatacgctggccacaagaatcagagtgccactctcctgggacaaagatcgtcatctaacaattcagctcctccaaagccaatgagtttaaagatagaaagaattagctcgtggaaaacaccaccacaggaaaatagagataaaaatctttccaggagacgtcaagacagaagagcaacacctactggaaggccaactccctgtgcagagagacgggggggtgtctgaagatggaaaggtggcctcggacacctgtgtcactctacactggccccttggaaaattcagattcagataaagttccacttaggtctaataaaagtactcaatttgttattcaaaa

SEQ ID NO: 189842 - DNA, 889 bp, Homo sapiens
  Payload ID: 17487
  Gene Symbol: TCP10L
  Gene Name: t-complex 10-like
  ENST ID: ENST00000491828
  CDS Start-End: 134-460
gttctcttcccaataacagccattacagcagcagatcatcagactccaccaagagcttgggagacagaagtctctgtgggctgatgttcatggaaaactccggagtcatatagatgctttgagggagcagaacatggagctccgagaaaagctgagagctctgcagctgcagcggtggaaagccaggaagaaatctgcagcgtccccacacgcggggcaagaatcgcacactctggcattggaacctgcttttggaaaaatttcacctctgtcagctgatgaagagacaatacccaaatacgctggccacaagaatcagagtgccactctcctgggacaaagatcgtcatctaacaattcagctcctccaaagctcctctttagaacattctcccagccagtgtgtctcttcctgtcccagctttgtgtcaccctcatactcaggaagcaaatctcgtgagtccacagccagcaactgatactgggttgatgtggatggagaaggcgcccccaactcctgaagatgatttatcccctcgcattctttcccaaagcaactgctgagcagataacactttattccctgaaggaagatcagaaatctactccaagcatttgtcacaaccaatgagtttaaagatagaaagaattagctcgtggaaaacaccaccacaggaaaatagagataaaaatctttccaggagacgtcaagacagaagagcaacacctactggaaggccaactccctgtgcagagagacgggggggtgtctgaagatggaaaggtggcctcggacacctgtgtcactctacactggccccttggaaaattcagattcagataaagttccacttaggtctaataaaagtactcaatttgttattcaaaa

SEQ ID NO: 189843 - DNA, 1488 bp, Homo sapiens
  Payload ID: 17488
  Gene Symbol: TCP10L2
  Gene Name: t-complex 10-like 2
  ENST ID: ENST00000283507
  CDS Start-End: 77-1000
gggaggacttggggacagctgtggggacacggcccagatgttctggtcccagcagaagtgactggcggggaccaggatgctggagggtcagctcgaggccagggagcccaaggagggcacccacccagaggacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggcattggaacctgcttttggaaaaatttcacctctgtcagctgatgaagagacaacgcccaaatacgctggccgcaagagtcagagtgcgactctcctgggacaaagatggtcatctaaccacttagctcctccaaagccaatgagtttaaagacagaaagaattaactcggggaaaacaccaccacaggaagatagagagaaaagtcctcccgggagacgtcaagacagaagtccagcacccactggaaggccgactcccggtgcagaaagacgggaggtgtctgaagacggaaagattatgcatccatcttcccgaagtctgcaaaactccggtggcagaaaatcaccagtgcaggcttcccaggccgccacgctgcaggagcagacggcagcagccggagttgctgacagaagctcatcagtcttagggagttctgaaggcggatttctcagccgcgttcaagctgaagagttcgccagttcttccccagacagtgcagagcggcagaaaaattctaccccaatggctccaaagaaatcgtgtttcccaatgggacagtgaaacatttcaaggatggacaggaagagaccttatttcctgatgggacaatcgtaagggtggaaaggaacggcgacaaaaccattgtgctcagcaacgggcagaaagaaatccacacagcccggttcaagaggagggagtacccggatggcaccgtcaagactgtgtattgcagcggctgtcaggaaaccaagtatgcctccgggagggttaagatcaaagatgaagctggaaatgtcgtcctggacgagaagcagatgagccctcaacacgcagcatcacatgggaaatgccaattgcagatttttgctaaaacagacaaaaactaataacatattagctgccctaaatgatcttggagagccaccaaaactttaggactacccaagtcatctagaaattgcaaaggaaaagacattctctcccctatttaggaaacttggttagagcagcacacgtcagagaacagaaggctcacaaaagaacgattt

SEQ ID NO: 189844 - DNA, 2185 bp, Homo sapiens
  Payload ID: 17488
  Gene Symbol: TCP10L2
  Gene Name: t-complex 10-like 2
  Uniprot ID: B9ZVM9
  ENST ID: ENST00000366832
  CDS Start-End: 132-1193
aagacagaaagtccgttggaaccgtcggctgctctctggtctctggagatgaggcgggaggacttggggacagctgtggggacacggcccagatgttctggtcccagcagaagtgactggcggggaccaggatgctggagggtcagctcgaggccagggagcccaaggagggcacccacccagaggacccgtgcccgggagctggggctgccatggagaagacacctgcagcagccgaggtccccagggaggacagcaatgccggggagatgccgtcattacagcagcagatcaccagcctccaccaagagctcgggagacagcagtcgctgtgggctgatattcacagaaaactccagagtcatatggatgccttgaggaagcagaaccgggagctccgagaagagctgagaggcctgcagcggcagcagtgggaagccgggaagaaacccgcagcgtccccacacgcggggcgagaatcacacactctggcattggaacctgcttttggaaaaatttcacctctgtcagctgatgaagagacaacgcccaaatacgctggccgcaagagtcagagtgcgactctcctgggacaaagatggtcatctaaccacttagctcctccaaagccaatgagtttaaagacagaaagaattaactcggggaaaacaccaccacaggaagatagagagaaaagtcctcccgggagacgtcaagacagaagtccagcacccactggaaggccgactcccggtgcagaaagacgggaggtgtctgaagacggaaagattatgcatccatcttcccgaagtctgcaaaactccggtggcagaaaatcaccagtgcaggcttcccaggccgccacgctgcaggagcagacggcagcagccggagttgctgacagaagctcatcagtcttagggagttctgaaggcggatttctcagccgcgttcaagctgaagagttcgccagttcttccccagacagtgcagagcggcagaatcttcctgtaaacccaccatcttccctggaaatagcacaggccatggacactaagatgaaaaaggaggaagtacaggaagaaaaacgacatccaaatggcaaggcagatgactgccggcggtccggtttcccgagtgaatttccaggagctctgcatgccgctccctccagacaggacatggggccctgacctggaggccaggcgtttctagcattgttgactgccagtttattaccagtaaataaagcaatacgcttttcaggaggaagatttgttttaaatacttaaaaaaaaacccaaaactatagcctcaaatatcttccagccaccacattttagcccttgaggagagctcagttccggaaggacgcgtcaaggtggcggtggtcggcattgactcaggaaggggtgggaagaggcacctgctgcggctgcggctgcggctacagtgttttgtgagctccgaggagacccagtcctgcctggggcagcacatcatcgctgcttcttcagctcaacagttcgttcatctcacgcctcttgctggcctgttagaaactgggagtcggcctcaggctagctttgctgagggaactctgcctcagtaaaagcgaattcatgtcttgcaagcggataaagcatttggataaatgaacaacagggaatgctacttgcagtaacagtttgaattcactgaaatgcttttgtctttagcgcagtggttgtagtggtttgtcaggggagaaggaaacccacatcatttgagcacctgaccttgccatccccataggcaggtccatgagacataagtgatgctcctccttggctaagtgcatggagaaaccaatcgctgaagctcatgaaaccacgaagatgaggacacaagaactaggtaacgcgctgtgccctctgctagcgcgatccttcctttctccccacaaccagcggtcacccacctctgcctgctcctacgtctctggctcccccaccctccctcccaggtcttcaacactttcctcttctcgtgactcatcttgcatctacttcttgtgtgtcttgcattggatatgccaaagttctttccttttttgtgttttctttcttttaataatataaactccaaaatagattgtttgattcttttcatgtggaacatttaaaatattatttgtgctttatta

SEQ ID NO: 189845 - DNA, 416 bp, Homo sapiens
  Payload ID: 17488
  Gene Symbol: TCP10L2
  Gene Name: t-complex 10-like 2
  ENST ID: ENST00000486697
  CDS Start-End: 284-416
ttatgagagtcagttttgccagtacacctctggatataaagaaaatcaaaatataagtgagcaaaaataagcccaaagacaaaagtggcaaggaggagaaaaatgggggctacagtctgaagttttatttcaacagggttaacataaacatagtgttttaagcttaaaatgatggaaaacccctacgtagatcttccaacgtggacattccaacaggaagctataaagagaagtaaaagtgacagcacattatcagtgaaaaataagactaggtttaaaaaggatgctggagggtcagctcgaggccagggagcccaaggagggcacccacccagaggacccgtgcccgggagctggggctgccatggagaagacacctgcagcagccgaggtccccagggaggacagcaatgccg

SEQ ID NO: 189846 - DNA, 1747 bp, Homo sapiens
  Payload ID: 17489
  Gene Symbol: TCP11X2
  Gene Name: t-complex 11 family, X-linked 2
  Uniprot ID: Q5H9J9
  ENST ID: ENST00000453326
  CDS Start-End: 330-1553
agacgcagaggcgaggccgccagtcgaggacgaggaggagataacatcaagatgccgaagactgaggaaactgtgctccagaatgatcccagtgtagcagagaatggggcccctgagcctaaaacaccagggcagagccagaaaagcaagagtttctgtttagatgaccagtctcctgacctgatgtcttttctgtcacagatctgatagagacagttaatgaagtttccaagctgagcatttcacatgaaattgtagtaaaccaagatttctatgtggaagagaccattttgcctccaaacagtgtagaaggcaggtttgcggaggcaatgtacaatgctttttggaaccatctgaaagaacagctattgagtactcctcctgacttcacttgtgcccttgaacttctaaaagatgttaaggagaaccgcctaagaaatgagatagaagaagctctggacacagatctcctcaagcaggaagcagaacatggggccctggatgtccctcatctttctaactacattctcaatttgatggctctgctatgtgcaccggttcgagatgaagcgatacagaaactagagaccataagagatccagtgcagttactgaggggcatcctccgtgttctgggcctaatgaaaatggacatggtgaactataccatccagagctttcgaccctacctgcaggaacattccatccagtatgaacaagctaaattccaggaactccttgataaacagcccagtctcctcgattataccacaaaatggctaaccaaagcagccacagacatcactacactatgtccgagttctcctgactcacctagctcctcctgcagcatggcgtgttcacttccaagcggggcaggtaacaattcagagccccccagtccaacaatggtgctataccaaggctacctgaacctcctcctctgggatcttgaaaacgtagaattcccagagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttgatcagtggatccgtttttttctcaaatgctgtttgcttcatggcatgcaggagtctctgctacactttcctggaggcctcattctcattgaaaaggagttggcagaactgggctggaagtttctcaatctgatgcatcataatcagcaggtatttggcccatactatgctgagatcctaaaacacatcatccatccagctcaagcacaagaaacagatgtggagcctaactgatagtgctggaccccagctatggcaacagggactcaggagagagaggtcagcatgtttctgggaggacatcacctgtggttagtcgaacagtcagccctcttcctcgctatagccaggacacagggatgcaggggtcaagcatgtaagcaccaactggcccaatccccttcactaataaacctctgagctgcaag

SEQ ID NO: 189847 - DNA, 2230 bp, Homo sapiens
  Payload ID: 17489
  Gene Symbol: TCP11X2
  Gene Name: t-complex 11 family, X-linked 2
  ENST ID: ENST00000429905
  CDS Start-End: 52-420
agacgcagaggcgaggccgccagtcgaggacgaggaggagataacatcaagatgccgaagactgaggaaactgtgctccagaatgatcccagtgtagcagagaatggggcccctgagcctaaaacaccagggcagagccagaaaagcaagagtttctgtttagatgaccagtctcctgatctgatagagacagttaatgaagtttccaagctgagcatttcacatgaaattgtagtaaaccaagatttctatgtggaagagaccattttgcctccaaacagtgtagaaggcaggtttgcggaggcaatgtacaatgctttttggaaccatctgaaagaacagctattgagtactcctcctgacttcacttgtgcccttgaacttctaaaagatgttaaggagaatcccggagatgaataggcgagcccttgcccacaaggaacttgcatgcttgagtcaaaaggctatttcaagggaaccttaaagattccagatttgctattttatcctcacactttggagtaaaacaatctaaaaatatccttatcctttattaagaatgcctcatctccttgtggtggtgtgtatttcatatttcttatatcccacacatttaaaaccacattcttatttttattcatatttttacctcattctacctaaaaaatagtaatgactactactataactgatcccagtgaagccttgaatggtaattgtcctctagacagaaagaaataatactctctaagaaatgtagagactcagttctctgcccccccagaagacataatctgggatgcctttggcctaagagcatagttcattggagaaagtttgaggttctgaacagaacttggctcctttgatttcctttgttgggcagaccttgctatcactgctattaccatggcagaaccgcctaagaaatgagatagaagaagctctggacacagatctcctcaagcaggaagcagaacatggggccctggatgtccctcatctttctaactacattctcaatttgatggctctgctatgtgcaccggttcgagatgaagcgatacagaaactagagaccataagagatccagtgcagttactgaggggcatcctccgtgttctgggcctaatgaaaatggacatggtgaactataccatccagagctttcgaccctacctgcaggaacattccatccagtatgaacaagctaaattccaggaactccttgataaacagcccagtctcctcgattataccacaaaatggctaaccaaagcagccacagacatcactacactatgtccgagttctcctgactcacctagctcctcctgcagcatggcgtgttcacttccaagcggggcagactctgctgatggacagaatccggctccaggaactggcattccagttgcaccagttaactgtcctggcctcagtcttgctagtggccagaagcttctctggtgaagttttattcagatcacctgaatttgtggatagactgaaatgcaccaccaaggccctaactgaggaatttatctccaggcctgaagagactatgctgagtgtgagtgaacaggtgtctcaggaagtccatcaaggccttaaggacatgggcctcactactctgagcagtgaaaacacagcatctcttctaggccaactccagaacatcaccaagaaagagaactgcattcgtagcattgttggagtctctgctacactttcctggaggcctcattctcattgaaaaggagttggcagaactgggctggaagtttctcaatctgatgcatcataatcagcagagtcatttttcacaaaacgaaatctttccagaagatcacgaataagagagatcaaagctaggcagcttgagttgaagtagagctggaagaaggagttttgaggactgtttcaaaaccactggactagatgatctctaaagtggtgacatggacataggataatggttatagacagtccccctcccaacgggaaaaaatgaaagcaagcaaaaagttaccagctccaagccaacttgaaatccaatcagcatttccaagttcgttctgtgagactgtagtgtcaggacaaagcaacaacaaaatgtgctctactctaaagaagtgtgggacatacagaactgaaggaggactaataacaacgaatgcaactaacacgtatttctccctcaataaacgccagatgttgtactacgtt

SEQ ID NO: 189848 - DNA, 2018 bp, Homo sapiens
  Payload ID: 17490
  Gene Symbol: TCP11
  Gene Name: t-complex 11, testis-specific
  Uniprot ID: Q8WWU5
  ENST ID: ENST00000244645
  CDS Start-End: 501-1826
agcctgccgcttccggctctggcggggggggcacgtgccccgtcccgttgccccggcgaccgcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgc

SEQ ID NO: 189849 - DNA, 2166 bp, Homo sapiens
  Payload ID: 17490
  Gene Symbol: TCP11
  Gene Name: t-complex 11, testis-specific
  Uniprot ID: Q8WWU5
  ENST ID: ENST00000311875
  CDS Start-End: 419-1969
atgtgaggaaagagcgcggcccctgcgcccctgcggcacacgctgtgaaacaaccctcctgggtgtggctcggcttctcggctgtccaaacagcctgaagaaaagccccatgcatgctctggcctcgtctcagcagttccaggccatccttctcgaggggcgggagctgaccggcatgaaccggccgcagcgagccgctcgaggcctggttggcttcgagctcaggagggacgcacgagcctgccgcttccggctctggcggggggggcacgtgccccgtcccgttgccccggcgaccgcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaa

SEQ ID NO: 189850 - DNA, 1689 bp, Homo sapiens
  Payload ID: 17490
  Gene Symbol: TCP11
  Gene Name: t-complex 11, testis-specific
  Uniprot ID: Q8WWU5
  ENST ID: ENST00000373974
  CDS Start-End: 143-1555
ccgtcccgttgccccggcgaccgcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtaggg

SEQ ID NO: 189851 - DNA, 1882 bp, Homo sapiens
  Payload ID: 17490
  Gene Symbol: TCP11
  Gene Name: t-complex 11, testis-specific
  Uniprot ID: Q8WWU5
  ENST ID: ENST00000373979
  CDS Start-End: 359-1684
ctcaggccccggcctttctcaccgtgcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcagagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaa

SEQ ID NO: 189852 - DNA, 1962 bp, Homo sapiens
  Payload ID: 17490
  Gene Symbol: TCP11
  Gene Name: t-complex 11, testis-specific
  ENST ID: ENST00000455706
  CDS Start-End: 121-285
gcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaa

SEQ ID NO: 189853 - DNA, 1690 bp, Homo sapiens
  Payload ID: 17490
  Gene Symbol: TCP11
  Gene Name: t-complex 11, testis-specific
  Uniprot ID: Q8WWU5
  ENST ID: ENST00000412155
  CDS Start-End: 95-1492
ctttctcaccgtgcgacgccccaacccgccgctccgccgcggtggtacgctccaggccgccaggccgcgaggcccaccgagcggacgccagtggatgacccgcggcgggggaggaggaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaa

SEQ ID NO: 189854 - DNA, 1841 bp, Homo sapiens
  Payload ID: 17490
  Gene Symbol: TCP11
  Gene Name: t-complex 11, testis-specific
  Uniprot ID: Q8WWU5
  ENST ID: ENST00000444780
  CDS Start-End: 111-1646
gttctcaggccccggcctttctcaccgtgcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctgtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaag

SEQ ID NO: 189855 - DNA, 1575 bp, Homo sapiens
  Payload ID: 17490
  Gene Symbol: TCP11
  Gene Name: t-complex 11, testis-specific
  Uniprot ID: Q8WWU5
  ENST ID: ENST00000418521
  CDS Start-End: 253-1575
agtcattctgagtgtgcctctgttggccacaaatgggtacaagagatgtaaattctgcagaggttgtgagtggcttagccagtgtttttcaatgagaaattccacagcatggaatttgagggtgcccaagggagctctctatgcctcttactgcaatcccatctctgttagccctgacagatctcagttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttga

SEQ ID NO: 189856 - DNA, 1180 bp, Homo sapiens
  Payload ID: 17490
  Gene Symbol: TCP11
  Gene Name: t-complex 11, testis-specific
  ENST ID: ENST00000427376
  CDS Start-End: 125-256
gaccgcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtct

SEQ ID NO: 189857 - DNA, 837 bp, Homo sapiens
  Payload ID: 17490
  Gene Symbol: TCP11
  Gene Name: t-complex 11, testis-specific
  ENST ID: ENST00000486638
  CDS Start-End: 173-837
cgacgccccaacccgccgctccgccgcggtggtacgctccaggccgccaggccgcgaggcccaccgagcggacgccagtggatgacccgcggcgggggaggaggagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaa

SEQ ID NO: 189858 - DNA, 574 bp, Homo sapiens
  Payload ID: 17490
  Gene Symbol: TCP11
  Gene Name: t-complex 11, testis-specific
  ENST ID: ENST00000505400
  CDS Start-End: 366-574
gtgcgacgccccaacccgccgctccgccgcggtggtacgctccaggccgccaggccgcgaggcccaccgagcggacgccagtggatgacccgcggcgggggaggaggagagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgag

SEQ ID NO: 189859 - DNA, 579 bp, Homo sapiens
  Payload ID: 17490
  Gene Symbol: TCP11
  Gene Name: t-complex 11, testis-specific
  ENST ID: ENST00000503195
  CDS Start-End: 158-283
acgctcctttgcccctttctgcccctcagcacccccaagaccctgaggccgctaccccccttcccgccgcccccagggacccccttggcaattggggaggccccttccccgacgccaacaacacgcctttctccctcacccagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagttctttctgtcacaggtctgacagaaaccgttaatgaagtttccaagctgagcaacaagattgggatgaattgtgattactacatggaagag

SEQ ID NO: 189860 - DNA, 576 bp, Homo sapiens
  Payload ID: 17490
  Gene Symbol: TCP11
  Gene Name: t-complex 11, testis-specific
  ENST ID: ENST00000509988
  CDS Start-End: 83-307
gcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctgcccgagggcagaggtcttcaaagagtttttggttctagagaaagaagtgacccaagcgtgattacttgaatctgacaagatttgagactgaagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagatcttgctatcactgctattaccacgccagaac

SEQ ID NO: 189861 - DNA, 1978 bp, Homo sapiens
  Payload ID: 17490
  Gene Symbol: TCP11
  Gene Name: t-complex 11, testis-specific
  ENST ID: ENST00000504758
  CDS Start-End: 25-189
ggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaa

SEQ ID NO: 189862 - DNA, 933 bp, Homo sapiens
  Payload ID: 17490
  Gene Symbol: TCP11
  Gene Name: t-complex 11, testis-specific
  ENST ID: ENST00000502480
  CDS Start-End: 1-736
agggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaa

SEQ ID NO: 189863 - DNA, 970 bp, Homo sapiens
  Payload ID: 17490
  Gene Symbol: TCP11
  Gene Name: t-complex 11, testis-specific
  ENST ID: ENST00000469514
  CDS Start-End: 111-380
gttctcaggccccggcctttctcaccgtgcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctcccttctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgag

SEQ ID NO: 189864 - DNA, 615 bp, Homo sapiens
  Payload ID: 17490
  Gene Symbol: TCP11
  Gene Name: t-complex 11, testis-specific
  ENST ID: ENST00000492680
  CDS Start-End: 306-615
gaccgcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaaca

SEQ ID NO: 189865 - DNA, 587 bp, Homo sapiens
  Payload ID: 17490
  Gene Symbol: TCP11
  Gene Name: t-complex 11, testis-specific
  ENST ID: ENST00000503908
  CDS Start-End: 83-325
gcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctcttcaacaatgatcaactcgtggccaatctttgttcatctacatctcctccacatcttggagccaaataattttctgtgaaaaatcatgatgctgcatcaaaagagagtgataaaatatgatttattgtatacggctgcattttatacaccacgtaatcattttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcag

SEQ ID NO: 189866 - DNA, 657 bp, Homo sapiens
  Payload ID: 17490
  Gene Symbol: TCP11
  Gene Name: t-complex 11, testis-specific
  ENST ID: ENST00000507706
  CDS Start-End: 404-657
ctcaggccccggcctttctcaccgtgcgacgccccaacccgccgctccgccgcggtggtacgctccaggccgccaggccgcgaggcccaccgagcggacgccagtggatgacccgcggcgggggaggaggagagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcagga

SEQ ID NO: 189867 - DNA, 1974 bp, Homo sapiens
  Payload ID: 17490
  Gene Symbol: TCP11
  Gene Name: t-complex 11, testis-specific
  ENST ID: ENST00000505911
  CDS Start-End: 36-200
ccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaa

SEQ ID NO: 189868 - DNA, 474 bp, Homo sapiens
  Payload ID: 17490
  Gene Symbol: TCP11
  Gene Name: t-complex 11, testis-specific
  ENST ID: ENST00000505335
  CDS Start-End: 88-219
accgtgcgacgccccaacccgccgctccgccgcggtggtacgctccaggccgccaggccgcgaggcccaccgagcggacgccagtggatgacccgcggcgggggaggaggagtctggaaggcaaggtcaaggagacagtgcacaatgccttttgggaccatcttaaagagcaactatcagcaactccccctgacttcagctgtgctcttgaacttctgaaagaaattaaagagggctgagagaggccaaccaaggacctcatttgagagggcatagctatgccatgagacgttactggcctgtgtatgctgctgaccacagtgcactgcaggaaccaagcactggagaagctattcatgctgcaggagccaagtactgcaggagcctgctgagtgaacataccagaaccgggaataaaagctcttgcctttgcaatgtctttctaatcttgctatcactgctattaccacgcca

SEQ ID NO: 189869 - DNA, 558 bp, Homo sapiens
  Payload ID: 17490
  Gene Symbol: TCP11
  Gene Name: t-complex 11, testis-specific
  ENST ID: ENST00000514751
  CDS Start-End: 83-247
gcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagcttcaacaatgatcaactcgtggccaatctttgttcatctacatctcctccacatcttggagccaaataattttctgtgaaaaatcatgatgctgcatcaaaagaga

SEQ ID NO: 189870 - DNA, 758 bp, Homo sapiens
  Payload ID: 17490
  Gene Symbol: TCP11
  Gene Name: t-complex 11, testis-specific
  ENST ID: ENST00000479418
  CDS Start-End: 36-143
ccaggccgcgaggcccaccgagcggacgccagtggatgacccgcggcgggggaggaggagataccatcagcaaaatgccagacgtcaaggagagtgtgcccccgaaatatcctggcgactcagagggcagagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagaggagactggagggagagattctcctgctggccctgaagaagcaaacagctgtgttgtgaactgcctatcgagagggccacatagcaaggagctgcaggtggcttctaggacccggggttagcatccagacaatagccaatcttgctatcactgctattaccacgccagaaccgcctgagaattgagattg

SEQ ID NO: 189871 - DNA, 1669 bp, Homo sapiens
  Payload ID: 17490
  Gene Symbol: TCP11
  Gene Name: t-complex 11, testis-specific
  Uniprot ID: Q8WWU5
  ENST ID: ENST00000512012
  CDS Start-End: 158-1669
acgctcctttgcccctttctgcccctcagcacccccaagaccctgaggccgctaccccccttcccgccgcccccagggacccccttggcaattggggaggccccttccccgacgccaacaacacgcctttctccctcacccagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttga

SEQ ID NO: 189872 - DNA, 2130 bp, Homo sapiens
  Payload ID: 17490
  Gene Symbol: TCP11
  Gene Name: t-complex 11, testis-specific
  Uniprot ID: Q8WWU5
  ENST ID: ENST00000611141
  CDS Start-End: 616-1938
agcctgccgcttccggctctggcggggggggcacgtgccccgtcccgttgccccggcgaccgcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgc

SEQ ID NO: 189873 - DNA, 2817 bp, Homo sapiens
  Payload ID: 17491
  Gene Symbol: TCP11L1
  Gene Name: t-complex 11, testis-specific-like 1
  Uniprot ID: Q9NUJ3
  ENST ID: ENST00000334274
  CDS Start-End: 401-1930
atgttttccacctctccctgaggaaacacggcgccgcccagctgcgagtcaccgcttactgaaccccttcggcaagcaggggaaagaccctcccgcctttccgtacgaagacatggcgctgccctatattgggctggcgcctcccggccaagagcagtctcctccttcctgatgctgagaagcggccgctctgaccgctgcccacccgagtcgggctgggaggaccgcccgccgcgtggcgagggatgcggcctcggaggggcagaggctgaaccgcccctgcctgccgcgcatccctccggcttccgccgcggcgccagcccgcgcctgattcgcggcgggagcggcaggagggagaacgccgactccgtggcaggaaagtgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggtgtcaccaacatggctctagcccatgaaattgtagtaaatggagactttcagattaaaccagttgaattaccagaaaacagcttgaagaagagagtaaaggagattgtacataaagcgttttgggattgcttgagtgtgcagctaagtgaagatcccccagcatatgaccatgctatcaaacttgtaggagaaatcaaagagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagtaagatcctcgtccgatcctaacgtgtatgcaccctacagcagcagtattactcactagccacagaatacctgttctgtactctaatgttgcattggaaaatggctatatagtacatgtctatttaacagcaccgattccaaagggaagaatattgtgtatcactgttgaaaagacttgttgagaaatccactgaattctattttgagagattgtatttatgagtgcaagtttacaaatcaaagaagcattttgttctcgagttttacaggtaacactcagctgttgtctccactcctcccccatcatgtccttccaaggaggctgggacctctctcttctgcaatctgggtagttctttcagatgcctcatgctgagctgacggccatccaagcgcaaaagagaccaagccatggcctcacctcctgccctccctcagacagccttgtccctcacccctcccttctggtatttttgttagaagggctatataacgtcttattgccattttctccccctatttattgcttcctccctgcctggcctagccagggctcccaagcccttttttctagaggagagttatttgtctctctctctttttttttttactttcttttttgtatttaaacattcttttaaccttcccccaaagatacagttattggactttaaaaagcttgttcttttatacaaaattactcctgcatctggttgagagcagttatgacttatgagatctagtgaaaggaaagtctttgactttcaagccttgaaagtcaaggaggaaatgtattgaaaaatagtttactgtaatgtgaacgaagagaaatgtctggaattcttactgaaaaattgaccctgagacaatacacagatgtgatgattgaattaaattctggaattaga

SEQ ID NO: 189874 - DNA, 2633 bp, Homo sapiens
  Payload ID: 17491
  Gene Symbol: TCP11L1
  Gene Name: t-complex 11, testis-specific-like 1
  Uniprot ID: Q9NUJ3
  ENST ID: ENST00000432887
  CDS Start-End: 217-1746
ggcctgaacagctgtttacaacggaatccggacgccgggcgcgagtggagctcagtgccagaggaggggattcccggcgccgggggacagagccccttttttcttttgccgaaagaccctttctgctggggagcctcttgtgtccagcctaggcccgcgtgcagcgccgacggatgaccgtcttcttggcaagaaagtgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggtgtcaccaacatggctctagcccatgaaattgtagtaaatggagactttcagattaaaccagttgaattaccagaaaacagcttgaagaagagagtaaaggagattgtacataaagcgttttgggattgcttgagtgtgcagctaagtgaagatcccccagcatatgaccatgctatcaaacttgtaggagaaatcaaagagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagtaagatcctcgtccgatcctaacgtgtatgcaccctacagcagcagtattactcactagccacagaatacctgttctgtactctaatgttgcattggaaaatggctatatagtacatgtctatttaacagcaccgattccaaagggaagaatattgtgtatcactgttgaaaagacttgttgagaaatccactgaattctattttgagagattgtatttatgagtgcaagtttacaaatcaaagaagcattttgttctcgagttttacaggtaacactcagctgttgtctccactcctcccccatcatgtccttccaaggaggctgggacctctctcttctgcaatctgggtagttctttcagatgcctcatgctgagctgacggccatccaagcgcaaaagagaccaagccatggcctcacctcctgccctccctcagacagccttgtccctcacccctcccttctggtatttttgttagaagggctatataacgtcttattgccattttctccccctatttattgcttcctccctgcctggcctagccagggctcccaagcccttttttctagaggagagttatttgtctctctctctttttttttttactttcttttttgtatttaaacattcttttaaccttcccccaaagatacagttattggactttaaaaagcttgttcttttatacaaaattactcctgcatctggttgagagcagttatgacttatgagatctagtgaaaggaaagtctttgactttcaagccttgaaagtcaaggaggaaatgtattgaaaaatagtttactgtaatgtgaacgaagagaaatgtctggaattcttactgaaaaattgaccctgagacaatacacagatgtgatgattgaattaaattctggaattaga

SEQ ID NO: 189875 - DNA, 3390 bp, Homo sapiens
  Payload ID: 17491
  Gene Symbol: TCP11L1
  Gene Name: t-complex 11, testis-specific-like 1
  ENST ID: ENST00000528107
  CDS Start-End: 1556-2020
gtggcaggtgagagcgggagctggggcggaggctggcggggcccgtccgggaggcgcgcggtccaagtcgcaggcatctcttcgcctcttcccgtcggatcccatcccgggatgtcgggggcaggcgaggaagaggcggggtccgcgggcgggtggagctcacccctcgaggctgtcctctcggcgcgcccgcgtcctcccctactcccggccctgccactccctcgctggcctgaacagctgtttacaacggaatccggacgccgggcgcgagtggagctcagtgccagaggaggggattcccggcgccgggggacagagccccttttttcttttgccgaaagaccctttctgctggggagcctcttgtgtccagcctaggcccgcgtgcagcgccgacggatgaccgtcttcttggcaagtgcgaggatcctcctcccctcggctctctttttagacacagtgggggttgaatggatgcgcgcgatataagcaaattaaatggttcgtggccgcatcctagagccctttaattagagttaccatttgtagaaggcctgccgtgcacaatccctcgtttcatctccccccaaaccgagcaggtaggtagctgtgttttacagaggaggacactgaagttacacagctagtaaagagccagaattggggcccaggtatgtctgaaaccaacgcccagcctcccagatacagtgacatcacagagatgacgtagggattcatctctatcaacagatacttgtgggtgtctatttgggggatatacagatggagcataagtggggaatatgactggtcctggctcttaagaagttcgaaatctaggtggggaattttaaaataaaaactagcacttttaccatctggccccaacgcatctttccatcatctctagccacttccttttctcattttcttgtgccttggcttctgccctctgagtgaaatgccctccttttcacctcctctccccctcctctccccctccagacatgttttaactaggtgaaatcctactccttttaaagatcagttcaaatgtcatcttttctgggaaggttttctcaatctcctcccaggcagagttagtttcttcctctgctatattccctgggcaatttcataatgccacttaagtttcattatggctccttgtaagcctgtctgcctccccctctagactatgtatttgcatctttctatttaaataagcacgctttgaattgaatttaaggcagtgacaaatgccaaatgtcaactagccagccctgcaggagttgagaaaggtgcaatcactggtgaggtccgggaagtgtcctgggaagagacaggacttgaactcaatcttaaggatggggttagtttactaagctgagcattagagacctagaaatcctccctttcctcctcactgcacagaatgaattacttcatccctcctgggctccttctcagcatgtgaagataataaaattagcagcgttttgtttgtcgtttctcacagaatatgctggaaagtgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggtgtcaccaacatggctctagcccatgaaattgtagtaaatggagactttcagattaaaccagttgaattaccagaaaacagagtctcgctctgttgtccaggctggagtgtagtggcactatctcggctcactgcaacctctggccaggctgatctcgaactcctcacctcaggtgaactgcctgcctcggcctccaaaagtgctgggattacaggccttgaagaagagagtaaaggagattgtacataaagcgttttgggattgcttgagtgtgcagctaagtgaagatcccccagcatatgaccatgctatcaaacttgtaggagaaatcaaagagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagtaagatcctcgtccgatcctaacgtgtatgcaccctacagcagcagtattactcactagccacagaatacctgttctgtactctaatgttgcattggaaaatggctatatagtacatgtctatttaacagcaccgattccaaagggaagaatattgtgtatcactgttgaaaagacttgttgagaaatcca

SEQ ID NO: 189876 - DNA, 1898 bp, Homo sapiens
  Payload ID: 17491
  Gene Symbol: TCP11L1
  Gene Name: t-complex 11, testis-specific-like 1
  Uniprot ID: Q9NUJ3
  ENST ID: ENST00000531632
  CDS Start-End: 197-1726
tacaacggaatccggacgccgggcgcgagtggagctcagtgccagaggaggggattcccggcgccgggggacagagccccttttttcttttgccgaaagaccctttctgctggggagcctcttgtgtccagcctaggcccgcgtgcagcgccgacggatgaccgtcttcttggaaagtgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggtgtcaccaacatggctctagcccatgaaattgtagtaaatggagactttcagattaaaccagttgaattaccagaaaacagcttgaagaagagagtaaaggagattgtacataaagcgttttgggattgcttgagtgtgcagctaagtgaagatcccccagcatatgaccatgctatcaaacttgtaggagaaatcaaagagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagtaagatcctcgtccgatcctaacgtgtatgcaccctacagcagcagtattactcactagccacagaatacctgttctgtactctaatgttgcattggaaaatggctatatagtacatgtctatttaacagcaccgattccaaagggaagaatattgtgtatcactgttgaaaagacttgttgagaaatccactg

SEQ ID NO: 189877 - DNA, 2468 bp, Homo sapiens
  Payload ID: 17491
  Gene Symbol: TCP11L1
  Gene Name: t-complex 11, testis-specific-like 1
  ENST ID: ENST00000527661
  CDS Start-End: 246-2033
agtctcctccttcctgatgctgagaagcggccgctctgaccgctgcccacccgagtcgggctgggaggaccgcccgccgcgtggcgagggatgcggcctcggaggggcagaggctgaaccgcccctgcctgccgcgcatccctccggcttccgccgcggcgccagcccgcgcctgattcgcggcgggagcggcaggagggagaacgccgactccgtggcaggaaagtgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggtgtcaccaacatggctctagcccatgaaattgtagtaaatggagactttcagattaaaccagttgaattaccagaaaacagcttgaagaagagagtaaaggagattgtacataaagcgttttgggattgcttgagtgtgcagctaagtgaagatcccccagcatatgaccatgctatcaaacttgtaggagaaatcaaagagactctcttatctttcttgctgcctggtcatactagactgagaaaccagataacagaagtcttggatctggatctgataaagcaggaagcagagaatggggcgctagacatttccaagctggcagaattcattattggcatgatggggacactgtgtgcacctgctcgagatgaggaagttaagaaactaaaggacattaaggaaatagtgccccttttcagagaaattttttctgtgttggacctaatgaaagtggacatggccaactttgctatcagtagcatcaggcctcatctcatgcagcagtcagttgaatacgaaaggaagaagtttcaagagattttggagaggcaaccaaattccctggactttgtcacccagtggctggaagaagcctcagaggaccttatgactcagaagtataaacacgccctgccagtggggggaatggctgctggctctggggacatgcccaggctgagccctgttgctgtccagaattacgcttacctgaagcttctgaagtgggaccacctccagaggccgttccccgaaacagttttaatggaccagtctcgcttccacgagctccagttgcagctggaacaactgaccatcctgggggctgtgttgctggtcaccttcagcatggcagcgccaggaatttccagccaggccgactttgctgagaaactcaagatgattgtgaagattttgctaacagatatgcacctgccctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgagaaaaagatggatatcttttggcaatttctttgggtccagcaatactgatatgagtccttggaattgtaggactgattatcccatgagtctgcacattagatttccaaagaaccatgtgatagaggcaccaatgacaatacaactttgtttccaagaaccttgtaacaaagcgttgtctcttttaaacataccacttgaggcaaaaggaatcctggacaggagttttctgcagaggcgtttaaaaccctaccgaatccgcttctgctgccgtgctctgtaaatgtcatgaacaggggggacaacggctcccttttcttcatcttcatctgaatcctcgttgggccttttgacggccttgtctctccagagctgttcaatgttgatcatcggattaacacaacctcgttgataaactcttcggacagctgttattctttgattttctgcataagatcctacagcttccctgagattggataagaaatgccatcaattatattataaccaaatctcattcaacccagcaatctcactactggatatctacccaaagaacaactctatggaaaatagtatggagatttctcaaagaactaaaaattatattttagctaaatcaactgtagatgtaaaaaaaaactatacaaatacttacacgccttttaggaaattgatgtaatccacccaaatctaagaaataaaatgaaatgttaat

SEQ ID NO: 189878 - DNA, 547 bp, Homo sapiens
  Payload ID: 17491
  Gene Symbol: TCP11L1
  Gene Name: t-complex 11, testis-specific-like 1
  ENST ID: ENST00000528898
  CDS Start-End: 385-547
gtttacaacggaatccggacgccgggcgcgagtggagctcagtgccagaggaggggattcccggcgccgggggacagagccccttttttcttttgccgaaagaccctttctgctggggagcctcttgtgtccagcctaggcccgcgtgcagcgccgacggatgaccgtcttcttggcaagtgcgaggatcctcctcccctcggctctctttttagacacagtgggggttgaatggatgcgcgcgatataagcaaattaaatggttcgtggccgcatcctagagccctttaattagagttaccatttgtagaaggcctgccgtgcacaatccctcgtttcatctccccccaaaccgagcaggaaagtgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcact

SEQ ID NO: 189879 - DNA, 905 bp, Homo sapiens
  Payload ID: 17491
  Gene Symbol: TCP11L1
  Gene Name: t-complex 11, testis-specific-like 1
  ENST ID: ENST00000530419
  CDS Start-End: 474-905
atgttttccacctctccctgaggaaacacggcgccgcccagctgcgagtcaccgcttactgaaccccttcggcaagcaggggaaagaccctcccgcctttccgtacgaagacatggcgctgccctatattgggctggcgcctcccggccaagagcagtctcctccttcctgatgctgagaagcggccgctctgaccgctgcccacccgagtcgggctgggaggaccgcccgccgcgtggcgagggatgcggcctcggaggggcagaggctgaaccgcccctgcctgccgcgcatccctccggcttccgccgcggcgccagcccgcgcctgattcgcggcgggagcggcaggagggagaacgccgactccgtggcagaccctttctgctggggagcctcttgtgtccagcctaggcccgcgtgcagcgccgacggatgaccgtcttcttggaaagtgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggtgtcaccaacatggctctagcccatgaaattgtagtaaatggagactttcagattaaaccagttgaattaccagaaaacagcttgaagaagagagtaaaggagattgtacataaagcgttttgggattgcttgagtgtgcagctaagtgaagatcccccagcatatgaccatgctatcaaacttgtaggagaaatcaaagagactctcttatctttc

SEQ ID NO: 189880 - DNA, 711 bp, Homo sapiens
  Payload ID: 17491
  Gene Symbol: TCP11L1
  Gene Name: t-complex 11, testis-specific-like 1
  ENST ID: ENST00000528962
  CDS Start-End: 1-475
ctccttccatctgaaggacgtcctcactaccatcggggagaaggtgtgcctggaggtgagcagctgcctctccctgtgtgggtcctctcccttcaccacggacaaggagaccgtgctcaagggccagatccaggccgtggccagtcccgatgaccccattcgcaggatcatggaatctcgaatcctgaccttcttagaaacctaccttgcctcgggtcatcagaagccattgcccacagtccctgggggactcagtccagttcagagagagctggaggaagttgctattaaatttgctcgcctggtcaactataacaagatggtcttctgtccctactacgatgcaatcctgatctctccagagctgttcaatgttgatcatcggattaacacaacctcgttgataaactcttcggacagctgttattctttgattttctgcataagatcctacagcttccctgagattggataagaaatgccatcaattatattataaccaaatctcattcaacccagcaatctcactactggatatctacccaaagaacaactctatggaaaatagtatggagatttctcaaagaactaaaaattatattttagctaaatcaactgtagatgtaaaaaaaaactatacaaatacttacacgccttttaggaaattgatgtaatccacccaaatctaagaaataaaatgaaatgttaata

SEQ ID NO: 189881 - DNA, 747 bp, Homo sapiens
  Payload ID: 17491
  Gene Symbol: TCP11L1
  Gene Name: t-complex 11, testis-specific-like 1
  ENST ID: ENST00000602733
  CDS Start-End: 430-747
ggagctggggcggaggctggcggggcccgtccgggaggcgcgcggtccaagtcgcaggcatctcttcgcctcttcccgtcggatcccatcccgggatgtcgggggcaggcgaggaagaggcggggtccgcgggcgggtggagctcacccctcgaggctgtcctctcggcgcgcccgcgtcctcccctactcccggccctgccactccctcgctggcctgaacagctgtttacaacggaatccggacgccgggcgcgagtggagctcagtgccagaggaggggattcccggcgccgggggacagagccccttttttcttttgccgaaagaccctttctgctggggagcctcttgtgtccagcctaggcccgcgtgcagcgccgacggatgaccgtcttcttggcaagaaagtgaataaacttaattgagaatgtctgaaaaccttgacaagtccaatgtaaatgaagcaggaaaatcaaaatccaatgattctgaggaaggcctcgaagatgctgtggaaggtgctgatgaagccttacaaaaagcaataaagtcagactcctccagcccccaaagagtgcagagacctcactctagtcctcctcgctttgtgacagtagaagaacttctagagacagcgagaggtgtcaccaacatggctctagcccatgaaattgtagtaaatggagactttcagattaaaccagttgaattaccagaaaacagcttgaagaagagagtaaaggag

SEQ ID NO: 189882 - DNA, 2219 bp, Homo sapiens
  Payload ID: 17492
  Gene Symbol: TCP11L2
  Gene Name: t-complex 11, testis-specific-like 2
  Uniprot ID: Q8N4U5
  ENST ID: ENST00000299045
  CDS Start-End: 175-1734
gggacactggggctgggggggtttgttgggctggtgagttttcgaggtgactgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagtgctcttgatcagactacagaatggataaaagaatctgtaaatgaagaattattttctctttctgagagtgctttaactcctggggccgaaaatacctccaagccaagcctgagccctactttggtgctaaataatagttacttgaaactgttacagtgggattatcagaaaaaagaattaccagagacacttatgacagatggagcacgtcttcaggaactaacagaaaagctgaatcaattgaaaattattgcctgcctgtccctaattaccaacaacatggtgggtgctattacaggaggcctgcctgagcttgcaagcaggttaacaaggatttcagctgttctacttgaaggcatgaacaaagagacctttaacttgaaggaagtcctgaattctattggtattcagacttgtgttgaggttaacaagaccctgatggaaagaggtttacccactttaaatgctgagattcaagctaatcttataggtcaattttcaagcattgaagaggaggacaatcctatctggtccttgattgataaacgaattaagctttacatgagaaggctactttgtcttccaagccctcaaaaatgcatgcctcctatgccaggaggcctagctgtcattcagcaggagctagaagccctaggctctcaatatgcaaacattgtgaatctcaacaaacaagtgtatggaccattttatgcaaatatacttcgaaagctgctcttcaatgaggaagccatggggaaggtagatgcttcacctcctactaactaaagaagaactgacattggacgagagattggaaatccagtactttggtatccagtccacttccattgatggcattagagatccagcacattctcagtactgtggtgcagtattagcccaaatctgtgtaatgggtaatattagcattacagaagacacacacatcacatagaccctcagaagacgtaaacatcacatagaccctatttgtgcatcattttcaagtttaaaacaaatatttgtaatgaacagaaaacaatttgtaattaattatattacctatataatacttgtaaatgttttcttaaccatttatatttggcttatgacatttaacccctaaggagttgtttttctcacttgttattatcaaacctaatggtttttaattttggtacaactccttaaagggttgaaggttgtgacaataactgagggaactgatgttctgaataaatgatgtgaagtaaacacaattgtatttgaaa

SEQ ID NO: 189883 - DNA, 625 bp, Homo sapiens
  Payload ID: 17492
  Gene Symbol: TCP11L2
  Gene Name: t-complex 11, testis-specific-like 2
  ENST ID: ENST00000551802
  CDS Start-End: 231-625
aaggcggggtcaggggccatcaagctcggctcctagttcatgtcttcccactccgcgtccccttgtttgacctcgaactgccgtcccgcgtgggagcggggagcggggcaccgagtggccgccccgcgtgtcggggtggacacggacttcgggcctcggaggccgcttcgccgctgtttaaatcctgctggacaggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaact

SEQ ID NO: 189884 - DNA, 153 bp, Homo sapiens
  Payload ID: 17492
  Gene Symbol: TCP11L2
  Gene Name: t-complex 11, testis-specific-like 2
  ENST ID: ENST00000553143
  CDS Start-End: 101-153
acgcacgccaagtcttcagagggcctggatgggtgtgactccaaggagctaatcgtcccgtgcaggtgctacctttttacccacacttaagtgacgcaaaatgcccttcaatggcgagaagcagtgtgtgggagaggaccagccaagcgattc

SEQ ID NO: 189885 - DNA, 1067 bp, Homo sapiens
  Payload ID: 17492
  Gene Symbol: TCP11L2
  Gene Name: t-complex 11, testis-specific-like 2
  ENST ID: ENST00000548428
  CDS Start-End: 775-1067
gggtgaggtcgtgcagactgctgctgcgtccccttgccgggacctttggttaaggggaagaggtggagaaaagccgattgggcctgggctcgaacgctgaaccctcaggtgttgcttgtgcttcccaaagctgctactgtaggtggcaccactgggggtaatagcaatgatttgaggtggcatatggatgaacatagttacttgttttcgttactattaagaaaatctgttccattaagtaagcagtttcacaatgatagagtttccttttaaaataaatatatttaaatgcaaaaatctagtcaagatagagacgcggttactaaattatagtaaaggtaaggagggagacgtagaaatagtcatgaagagtggcactcaaacgacttaagtttgggaaatcttagatggttgtcctgctaccttaactgtgaagaaactggacaagttgtccttgtccccagtgggtgtctcagcacccatggtcaccagcccagtcagggactttgctcttcttacctgccaacggataatgagttaatctcagtggttcccacttgaggaggctccctgccgtggtccttttcctctcttctctagggatttcatgcatcaccctgacagccagtggaagttgcctgatttgaagaggcccagggccgaagatacccagtcatgtgtggaagcagcttcaatgccattttgtgagaggttgagggccccagagggggaagcacaggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagag

SEQ ID NO: 189886 - DNA, 534 bp, Homo sapiens
  Payload ID: 17492
  Gene Symbol: TCP11L2
  Gene Name: t-complex 11, testis-specific-like 2
  ENST ID: ENST00000549906
  CDS Start-End: 125-307
ctgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgctttgctttatgaacatcttactgcatgaagcctttctggaaagacttttggatatcactggattattggaccaaagtatatagacatttttaaggagaatcttgagtcagacctggcaaaagaaattaacagcagccaccccagcaacaagccctccaagggttgtaacatttgatgaagtgatggctacagcaaggaacttatcaaacttgactcttgctcatgagattgctgtaaatgagaactttcaattga

SEQ ID NO: 189887 - DNA, 985 bp, Homo sapiens
  Payload ID: 17492
  Gene Symbol: TCP11L2
  Gene Name: t-complex 11, testis-specific-like 2
  ENST ID: ENST00000553098
  CDS Start-End: 284-985
ctggtgagttttcgaggtgactgtgctgtgctcggtgaggggacgcccagagagccctgacccggggtcactccgtcgccgttctcctcttgtctacgtgctggacccgggatttcatgcatcaccctgacagccagtggaagttgcctgatttgaagaggcccagggccgaagatacccagtcatgtgtggaagcagcttcaatgccattttgtgagaggttgagggccccagagggggaagcacaggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcaga

SEQ ID NO: 189888 - DNA, 1788 bp, Homo sapiens
  Payload ID: 17492
  Gene Symbol: TCP11L2
  Gene Name: t-complex 11, testis-specific-like 2
  Uniprot ID: Q8N4U5
  ENST ID: ENST00000547153
  CDS Start-End: 175-975
gggacactggggctgggggggtttgttgggctggtgagttttcgaggtgactgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagaaaagccgaggttgcaggtgcctcatgaggctgaccttgcttttggaaccagagagagcagtcaccgtgccagcctgtgagagtgaagtctctgccgatccctaagagaagagccaacgtttcactctaaacgcatgctccttctgctttaccggtcattctcaagtctgactacaaattagaatcatctggggcgtttaaacacagaggcctgagccctgcctcagacagaataaatcaaagtctccaggagctgtgcccatgaactctttttttcctttttaaagctccccaggtgattctaaagtcagccaggattgagaaccactatgccacactgttgcttttgttcaaggtaactaaatgggctcttaaatgtgtcagctgtaaatgattaaacttgcagtataaatgcttattactgccacattgtaattatattcacgatgatttccactcgcgctctctcagttggatgtcttttaaatgaaagactgcaagtcttttacatctttataaaacagaactagcaaaccaaaaacaacatttgccaactgaggagaaacaagagttgtgaaattctgggggtggtgttgctttagtgtggcaaacagaactactcataaattatccctgctcaagtgctgggtccaagaagaatttcagtctctctctactctgcacctgtgttcaggctgtatttcttggcaattgtcaccttataaattctaccaaatgtataattgtataagaactgtggtataaaaagcaatttgtttctagtgggaaaccttagaactgggcctaaagcaaaataaagtgaattttgtcctaaggcaga

SEQ ID NO: 189889 - DNA, 3198 bp, Homo sapiens
  Payload ID: 17492
  Gene Symbol: TCP11L2
  Gene Name: t-complex 11, testis-specific-like 2
  ENST ID: ENST00000546625
  CDS Start-End: 160-978
ggggggtttgttgggctggtgagttttcgaggtgactgtgctgtgctcggtgaggggacgcccagagagccctgacccggggtcactccgtcgccgttctcctcttgtctacgtgctggacccggtgctacctttttacccacacttaagtgacgcaaaatgcccttcaatggcgagaagcagtgtgtgggagaggaccagccaagcgattctgattcttcccggttttccgaaagcatggcttcgctcagtgactatgaatgctccaggcagagctttgcaagtgactcctccagcaaatccagctctcctgcttcaacaagccctccaagggttgtaacatttgatgaagtgatggctacagcaaggaacttatcaaacttgactcttgctcatgagattgctgtaaatgagaactttcaattgaaacaagaggctctcccagaaaagagtttggctggtcgagtgaagcacattgttcaccaggccttctgggacgtcttggattcagaactaaatgctgaccctcctgagtttgaacatgccatcaaactgtttgaagaaatcagagagattcttctctcttttctcactcccggtggcaaccggcttcgcaaccaaatctgtgaagttttggacacagacctcattaggcagcaggctgagcacagtgctgttgacatccaaggcctggccaactatgtcatcagtacgatgggaaagctgtgtgctcccgtgcgagataatgatatcagagagttaaaggctactggcaacatcgtggaggtgctgagacaaatattccatgtcctggacctcatgcaaatggacatggccaattttacaattatgagtctcagaccgcaccttcaacgccagttggtggaatatgagagaaccaagttccaggaaattttggaagaaactccaagtgagtataatataatgtgtatttatattgaaattaggttaaaatgatgattttaaatgttaaaatttaaattaaattaaattaaattaaattaaattaataaataaataaaatttaatttaatttaaattaattaaaatttaaaatgttaaaggttaaaatgaaaattaggtgatgttttcatttttgacttcatatatagtatcactaaagaattttggcctttctattaaacatttttttaccttccaaaattgacatcacaaacttacagttgtttattctgtccaggaactgtgctaagcactattcgtttcttcattcattcaagatatatttattgagtgcctcctgtgtttcagacactgcttaggtgcagtggatactgcagcgaacagaatggaatacagttgccgtccccaaggagctgacattctagtaggcatgacaaataaataaacatatattgtcaggtgtattattaagtgctatgaagaaaaataggataaagggacagtaatgggtcagaagtgaggacagcattgttttttagatgtgatggactgggaaggtctctgtaagtaacatttgagtaaagtttgcaaagaaatgaggaaggggcatgtaaagatggggaaaagaacgttctagcctgagggactgcaggtacaaaggcactgaagcagaaactgcttatgagtttgacaaacacagggcagacattgtgacgggagtagagttggtaaggggagagtggtaagagatgaggctgaaaaggagataaaggcaggtcacatagagcattgttagtaaatgagaggagtttggatttcattccatgtgcggtggaaactcatcagagagttttaatcaggggagcaacatctgattttcatttttgaagaatattcttgttcctggctacagaataggtcatgtgggaacaaagagggaaacagaggtaccaattaggtggtattacagttgctcaggcaagaaatgatggtggcttgttccagatggtaatggtggaaggagtgagaagagaccagattctggatacattttgaaagtggagtaatcagatttgctgaagattggataagggagaaaagagttgagggtgactctaaggtttttggcctcgtacaaccgggtgaatggtcatacagtttgagtgaaactggtgagaccaggagaaagaaggttgggagatgacatggaatcaagagttcagtttggtgatgtaaacttttgagatttcatttgacatcaatgtggagatgttaggtaggcatttagatatgaattatgagtttacaggaataatggaaactgtatatgtatttgggaatcatcagtatatgtatgatatataaagccatggaactgggtactagttaacacttagaaaatccttatcacactctaagtactttacctgtacaaactaatttaatccttgcaacaactatatgaagttaccccccattttatgggtgcggaaactgaggcactgtgaggttaagtcactggcctatgtaacacacttaaaagtataggagctcacctaggaaggcagcttggctccatagtccatgttcctgtccattatattacactgggtgagactacctagggggagtgagtgtggactctgaaagaaactgacgtggggcactccagcagctagaagctgaagttgagatgaggaggagggtctaacaatggagactatgagggagtagccagagaggtagtgtgacagtcaggagaggcgggtgtcctgtaagatacgtgaagaaggtatttggagaaggaaggcatgtttggatttgacaagcattgctaagtggtcaagaaagacacaggccaacttgaccattggatttgactgtttgatgatggtcagtaaccttgatgagagtggtttcagtggatttgtgtgcattaaagccagactgggcagggcacagtggctcacacctgtaatcctagcactttgggaggccgaggcaggcacatcacctgagatcaggagttcaagaccagcctggccaacatgctgaaaccccttctctactaaaatctaaaaattagccgggatgatggcaggtgcctgtaatcccagctgctcgggaggttgagatgggagaatcgcttgaacccaggagatggtggttgcagtgagccaaggtcgcatcattgcactccagcctggggggctgagcaagactccgtctcggaaaaaaaaaaaaaaaaaaaaa

SEQ ID NO: 189890 - DNA, 544 bp, Homo sapiens
  Payload ID: 17492
  Gene Symbol: TCP11L2
  Gene Name: t-complex 11, testis-specific-like 2
  ENST ID: ENST00000551228
  CDS Start-End: 492-544
tggcactcaaacgacttaagtttgggaaatcttagatggttgtcctgctaccttaactgtgaagaaactggacaagttgtccttgtccccagtgggtgtctcagcacccatggtcaccagcccagtcagggactttgctcttcttacctgccaacggataatgagttaatctcagtggttcccacttgaggaggctccctgccgtggtccttttcctctcttctctagggatttcatgcatcaccctgacagccagtggaagttgcctgatttgaagaggcccagggccgaagatacccagtcatgtgtggaagcagcttcaatgccattttgtgagaggttgagggccccagagggggaagcacagtgacctgctatcgtgttggaggctttgcttggagtcatcttcagtcttttctgttgactttacctttgaccagtgattaaatcctccaggtgctacctttttacccacacttaagtgacgcaaaatgcccttcaatggcgagaagcagtgtgtgggagaggaccagccaagcgattc

SEQ ID NO: 189891 - DNA, 616 bp, Homo sapiens
  Payload ID: 17493
  Gene Symbol: TCTE1
  Gene Name: t-complex-associated-testis-expressed 1
  ENST ID: ENST00000371504
  CDS Start-End: 4-600
cgcatgttcttcgagcggcacctggagaacctgctaaagcactttatcccaggcaccacagaccctgcggtgatcctcgacctgctgccgctctgccggaattacgtgcgcagggtccacgtcgatcagttccttccgccggtgcagctcccggcccagctccggccgggcgaccagtccgactcaggcagcgagggagagatggaggagcccaccgttgaccactaccaactgggcgatctggtagctggcctgagccacctggaggagctggacctggtgtacgatgtcaaggactgcggcatgaatttcgagtggaatctcttcctcttcacctaccgtgactgcctctccttggcagccgccatcaaggcatgccacaccctcaaggacggtgggaagcagctcctggaaggcatgtcagacaacaagaccctcctggaatttgacttgcgcctgtcagatgtggcccaggaaagcgagtacctcattggccaggccctctacgcaaaccgagaagcagcccgccagcgggccctgaatcccagccacttcatgtcaaccataactgccaatggccctgagaactctgtgggataaaatgacctgacttgga

SEQ ID NO: 189892 - DNA, 3067 bp, Homo sapiens
  Payload ID: 17493
  Gene Symbol: TCTE1
  Gene Name: t-complex-associated-testis-expressed 1
  Uniprot ID: Q5JU00
  ENST ID: ENST00000371505
  CDS Start-End: 124-1629
gtgaggcgagcgccggggctcccggagcggatccctacctgtttcaaggacctgccagtctgagaagcttcttgtcataaggccatccaggggccacgcacccctaccttgccagcctccagcatgcaggataccgtaacgacatcagcattgttggaccccagccactcctcagtctccacccaggacaattcctccactggaggacacacttcaagcacaagcccacagctctcaaagccttcaatcacaccagtccctgcaaagtccaggaacccacatcccagggccaatatccgtcggatgcgccggatcattgctgaggatcctgagtggtcactggccatcgtgcccctcctcacagagctctgcattcagcacattatcaggaacttccagaaaaaccctatcctgaagcagatgctcccggaacaccagcagaaggtcctgaaccacctgtcccctgacctaccactggctgtgaccgccaacctgatagacagtgagaactactggctccgctgctgcatgcatcgctggcccgtgtgccacgtggcccaccatggcggcagctggaaacgcatgttcttcgagcggcacctggagaacctgctaaagcactttatcccaggcaccacagaccctgcggtgatcctcgacctgctgccgctctgccggaattacgtgcgcagggtccacgtcgatcagttccttccgccggtgcagctcccggcccagctccggccgggcgaccagtccgactcaggcagcgagggagagatggaggagcccaccgttgaccactaccaactgggcgatctggtagctggcctgagccacctggaggagctggacctggtgtacgatgtcaaggactgcggcatgaatttcgagtggaatctcttcctcttcacctaccgtgactgcctctccttggcagccgccatcaaggcatgccacaccctcaagatcttcaagctgacccgaagcaaggtggatgatgacaaggcacgcatcataattcgaagccttctggaccacccagtcctcgaggagctggacttgtcacaaaacctcattggagaccgtggtgcacgaggtgctgccaagctgctgagccacagccgcctgcgtgtgctcaacctggctaacaaccaggtgcgtgcacccggtgcccagtccctggctcacgctctggcacacaacaccaacctcatttccctcaacctacgtctcaactgcatcgaggatgagggtggccaggctcttgcccatgccttgcagaccaacaagtgcctcaccacgctgcacctcggtggcaatgagctgtctgagcccaccgccacactcctgtcacaggtgctcgccatcaacaccacactcaccagcatcaacctgtcctgcaaccacatcgggctggacggtgggaagcagctcctggaaggcatgtcagacaacaagaccctcctggaatttgacttgcgcctgtcagatgtggcccaggaaagcgagtacctcattggccaggccctctacgcaaaccgagaagcagcccgccagcgggccctgaatcccagccacttcatgtcaaccataactgccaatggccctgagaactctgtgggataaaatgacctgacttggatcatggccccagccccatccctcatttcatacccctgccatgcctgctgcagagtatcacactggttcagagggagcggggagggggactgtgaataaccttggagtgatcaagggttgtatggatggagacatgaggcagggaagggagcctggcatgggggaagaaagggtatgcagtagggacccagcctttgtgcccagggaaaggatattactggacacccacaaatgaccaacttctttcaggaacagggaagtcagagaggtgtctgagggactgtgcctgccagattctcccgttggggctgcctgcctccctgactccccaccattttcttctctaccaaacagatccttgatcttcaaacacacacacacacacacacacacacacacacacacacacacacacaccctctggctacagcagggctatgcctggctctctctgccaccctcatccctgtagatgcatttccctgttgcttgactctgctttaagtgatccagttctacaggccacgccatcccctagttccccaactcccaacctgggaaggggacaatgagctgacaccaggggctcagacccagtggactcctctggggaggcaactgtagatgacaacttccagggaaggatgacacaatccctgccacccaccccagagagcttccctgggagggagggaaagaagtgccacactgggacaggaagtcagtgagtcatccacgactttattatccaccagtttgatttgtacaatctttgcgcttaaatccacgacaaaaaggccacagtgtgatgcacccaattgacagagacctgtcttctccccagccaggcccagcccaccccacaagcccttgtccccaggacacatggagccttccaggtgccctacatgagtcccccatcactctgtagctgtccaccctggggccacacctacaggaatcacatcagcccccagggccacaagagacctagctgactgattcaggctgagcgccattgcccatcctccttgggctgattcattggcccagagcctccagaactgtgtccccaaagggcaggtcatgggctacaaccccagtccaggagtgcctgctctccagggactccttccgctaagcaggcgctgagcagagcaccaaagggggcttgggagtgactgcatgtgtgtgcctgtctaggcaacctagagtctgtctgtgcctgacaccctctgacagttccggagtgcaaacgtgtaggtgtgagggtgtgtgtgtgtgtgtgtgtgtgtatagccacagctgctagcagaagttctaattagagaaacaagaacattcagtgtaaagtttaattttagagattaattaattttctggttttcattttccctggcaatcagtaaagctaccaagaaaa

SEQ ID NO: 189893 - DNA, 769 bp, Homo sapiens
  Payload ID: 17494
  Gene Symbol: TCTE3
  Gene Name: t-complex-associated-testis-expressed 3
  Uniprot ID: Q8IZS6
  ENST ID: ENST00000366774
  CDS Start-End: 102-698
cgaggcgcaggtgggagacttccgccctcgcgggactggctagggcgtttgaccgccggcggtgaaggggaggcggtgggcgtcttggagaacagagcgagatggagaagcgaggccgaggcgtgaagtcgagccccatccagaccccgaaccagacccctcagcaggctccggtgacgcctaggaaagaaaggaggcctagcatgttcgagaaggaggcatatacacagattttaagagaaagactgagagagtcaattcacaatgttcagtatgtggagcctccttttgatgactcaattgctgatataggtaaagaatggaagagtgccctggcaaaattaaagtttgctaattcatatagaatggagccattgaagaaattccaagctcattcagtagaaactaaagtccagcagatactaacagaaagtcttaaagatgtcaaatatgatgataaagtattctctcacttgtcacttgaattggcagaccgcatactgttagcagtcaaagaatttgggtaccaccgttataagttcattataaaagtattatttattcaaaagactggccaagcaataaatattgccagcagatggatctgggacattgcatgggacagctgggtcgcagctaaacacgaagcagaatcctacgtggcactggtcttggtgtttgccctttattatgaatagctcattacaggtactaaggattgtttacttccgaacttttcaaaaataaatgaaatttacatatttgtaaa

SEQ ID NO: 189894 - DNA, 769 bp, Homo sapiens; identical to SEQ ID NO: 189893
  Payload ID: 17494
  Gene Symbol: TCTE3
  Gene Name: t-complex-associated-testis-expressed 3
  Uniprot ID: Q8IZS6
  ENST ID: ENST00000610291
  CDS Start-End: 102-698

SEQ ID NO: 189895 - DNA, 2001 bp, Homo sapiens
  Payload ID: 17495
  Gene Symbol: TCTEX1D1
  Gene Name: Tctex1 domain containing 1
  Uniprot ID: Q8N7M0
  ENST ID: ENST00000282670
  CDS Start-End: 129-668
gagtccagggagagtgcgcgggcggccgccggctgaatgaagcctgggacgcgggagccgcgccgcgcgcagtgtctgcagtgccggaggtctgggaggctccgggcgaagcctccctgctgcaggttatgatgatgtcagacaatgctaaaggcagagcagctcattcatggaagaaaagagggagtatttcttctctaagtaatcatgaattttggcgaaaggaaattcatgggcgcatcaaagattctatgagtactgtgtcttatatggaagaacccagtcagcgtgatgatatctctcgccttacagttcagatggaaaacacctatcagttgggtcctcccaaacattttcctgtggtcaccgtcaatcatattttgaaagatgtagtaaccagctatctacaagtagaagaatatgaaccagagctctgtagacagatgactaaaaccatttctgaggttattaaagcccaggtcaaggacttgatgattccacggtataaactaattgtgattgttcacattggacaactgaacaggcagagcatacttattggaagcagatgcctctgggatcctaaaagtgataccttttcatcttatgttttcagaaattcttctctcttcgctcttgcaaatgtctatgcagtttaccttgagtgattgaaaataagaaatctagctcttacttttgaaaattctgaggcaggctgtatgtctgtacacaaaagttttactgccaaaaactttgagaaagaaacaacactgatatttcaagcaactggaagcttttgaattttttcatattctagtaaagatttggggaggggagggtagccacagaaagaatcttgtttatctaaagcaggaacttgatcttggttttgctggattgctttccatagacatagattcttattaaatatttgttttggtactaattattttaattattctttaattagagtgttacaatttcctgcattgttttttaataaaaagaagctttagaaaaactatggctatataccctgaccaataaatgatagtagaatattcaacatggtatacacaaatgataaataatgtgcctcagtgctgcatataaaagaatactggttttcattttgtacttaataaattgagcagcattcattaagtgcaattattgttacatgtacctgacagttgaaactgctgaggtagaattaatggcttcataacaattatcgtggtcccacgggctgcaagctaaaactagaagctcttgtggcttgcctgcactttacacaattgtgggagaaccgaaagttggctcttcagtaatggaaactataaagtgaataaaggctttttgggacactgaagtagacattgtgatattaaatatacatgatgcttaatactaaatgtgtctgtaacacataaaatcatttattggaaagagacattgcttttaaatatcctaggctaacaaactttttcacaaaatatatggctggcaccttaacaaataaagcatgtgtagttaccattttactcctatgaatttaatactaaagtgacccagtgaggtttttgaatagacgggtgctaaaatttacagggctgaaatagcttattattctgctggttaatgtatcttacgccacggatcatttatttttatgaagctttcaagtctttgtgtgcaagtaaaatgatgttgtggcgttgttcttggatggtaagtggactgcctagaggacatttgttaaaggtcaaagacaaattgtacacatatggagaaaattagcaatgctgtagtcttaaggaaaaaatgatttatcattcatatcaaaaagagtttagcaaatggaaaaccagttaatgctttaattttaaaatgttttggtgtcttacttttccctaaaaatgacatgtagtaaaaaatggatacttttaaaatcccttcccttctgctattttctggcttttaaagtgattattcaaaatg

SEQ ID NO: 189896 - DNA, 1010 bp, Homo sapiens
  Payload ID: 17495
  Gene Symbol: TCTEX1D1
  Gene Name: Tctex1 domain containing 1
  ENST ID: ENST00000528352
  CDS Start-End: 94-324
aatgaagcctgggacgcgggagccgcgccgcgcgcagtgtctgcagtgccggaggtctgggaggctccgggcgaagcctccctgctgcaggttatgatgatgtcagacaatgctaaaggcagagcagctcattcatggaagaaaagagggagtatttcttctctaagtaatcatgaattttggcgaaaggaaattcatgggcgcatcaaagattctatgagtactgtgtcttatatggaagaacccagtcagcgtgatgatatctctcgccttacagttcagatggaaaacacctatcagttggcacaatataagggactttaatgaattgagtgatttgatgttgctttagtttcttcctcagcaaaaagcattgtattagactctgaggaggataaaatccgagcttgcttaccatttcactggaaacgcaggtcctcccaaacattttcctgtggtcaccgtcaatcatattttgaaagatgtagtaaccagctatctacaagtagaagaatatgaaccagagctctgtagacagatgactaaaaccatttctgaggttattaaagcccaggtcaaggacttgatgattccacggtataaactaattgtgattgttcacattggacaactgaacaggcagagcatacttattggaagcagatgcctctgggatcctaaaagtgataccttttcatcttatgttttcagaaattcttctctcttcgctcttgcaaatgtctatgcagtttaccttgagtgattgaaaataagaaatctagctcttacttttgaaaattctgaggcaggctgtatgtctgtacacaaaagttttactgccaaaaactttgagaaagaaacaacactgatatttcaagcaactggaagcttttgaattttttcatattctagtaaagatttggggaggggagggtagccacagaaagaatcttgtttatctaaagcaggaacttgatcttggttttgctggattgctttccatagacata

SEQ ID NO: 189897 - DNA, 673 bp, Homo sapiens
  Payload ID: 17496
  Gene Symbol: TCTEX1D2
  Gene Name: Tctex1 domain containing 2
  Uniprot ID: Q8WW35
  ENST ID: ENST00000325318
  CDS Start-End: 137-565
tgtgcggggcgctcgcgggcttcagcgaggcgggagggcggccctgttgccctggagacgctttccctgctgccggccgcgaccgcaacccgctaggccttcatcgcgagctacgcccggaccgagaagccccggcatggccacgtccatcggagtgtccttctcggtgggcgacggggtgcctgaggctgagaagaacgcaggggagcccgagaacacctatattctgcggcctgttttccagcagaggttcaggccctctgtggttaaagactgtatccatgctgtgctcaaggaggaactggcaaatgctgaatattctccagaagaaatgcctcagcttacaaaacatttatcagaaaacattaaagataaattaaaagaaatgggatttgaccgatacaaaatggtggtgcaagtagtgattggagaacaaagaggtgaaggagtattcatggcttctcgctgtttctgggatgctgacactgacaactatactcatgatgttttcatgaatgacagtttattctgcgttgtagcagcatttggctgtttctactactgaatgaatctttgaaaagctggtaaaagacatgaccatgaagaaatctgaactttttaatattgttaaatatcttgacaaaataaagatgttagtagtttgacaactgaa

SEQ ID NO: 189898 - DNA, 800 bp, Homo sapiens
  Payload ID: 17496
  Gene Symbol: TCTEX1D2
  Gene Name: Tctex1 domain containing 2
  ENST ID: ENST00000446494
  CDS Start-End: 148-546
gggagggcggctgtgcggggcgctcgcgggcttcagcgaggcgggagggcggccctgttgccctggagacgctttccctgctgccggccgcgaccgcaacccgctaggccttcatcgcgagctacgcccggaccgagaagccccggcatggccacgtccatcggagtgtccttctcggtgggcgacggggtgcctgaggctgagaagaacgcaggggagcccgagaacacctatattctgcggcctgttttccagcagaggttcaggccctctgtggttaaagactgtatccatgctgtgctcaaggaggaactggcaaatgctgaatattctccagaagaaatgcctcagcttacaaaacatttatcagaaaacattaaagataaattaaaagaaatgggatttgaccgatacaaaatggtggtgcaagtagtgattggagaacaaagaggtgaaggagtattgctggagtgcagtggcatgatctcggctcactgcaacctctgcctgccgggttcaagtgattctcctgcctcagcctcctgagtagctgggattacaggcgctcaccaccacgcccagcatggcttctcgctgtttctgggatgctgacactgacaactatactcatgatgttttcatgaatgacagtttattctgcgttgtagcagcatttggctgtttctactactgaatgaatctttgaaaagctggtaaaagacatgaccatgaagaaatctgaactttttaatattgttaaatatcttgacaaaataaagatgttagtagtttgacaactg

SEQ ID NO: 189899 - DNA, 603 bp, Homo sapiens
  Payload ID: 17496
  Gene Symbol: TCTEX1D2
  Gene Name: Tctex1 domain containing 2
  ENST ID: ENST00000426563
  CDS Start-End: 63-200
ggccgcgaccgcaacccgctaggccttcatcgcgagctacgcccggaccgagaagccccggcatggccacgtccatcggagtgtccttctcggtgggcgacggggtgcctgaggctgagaagaacgcaggggagcccgagaacacctatattctgcggcctgttttccagcagaggcgggttcaggccctctgtggttaaagactgtatccatgctgtgctcaaggaggaactggcaaatgctgaatattctccagaagaaatgcctcagcttacaaaacatttatcagaaaacattaaagataaattaaaagaaatgggatttgaccgatacaaaatggtggtgcaagtagtgattggagaacaaagaggtgaaggagtattcatggcttctcgctgtttctgggatgctgacactgacaactatactcatgatgttttcatgaatgacagtttattctgcgttgtagcagcatttggctgtttctactactgaatgaatctttgaaaagctggtaaaagacatgaccatgaagaaatctgaactttttaatattgttaaatatcttgacaaaataaagatgttagtagtttgacaactgaa

SEQ ID NO: 189900 - DNA, 763 bp, Homo sapiens
  Payload ID: 17497
  Gene Symbol: TCTEX1D4
  Gene Name: Tctex1 domain containing 4
  Uniprot ID: Q5JR98
  ENST ID: ENST00000339355
  CDS Start-End: 8-673
caggtccatggccagcaggcctctgcccccgggacgccaggaggaggagaatgccaaagactccgggcggaaaccctcaccggtgcggccccgaggctgcctgcccagcattgatgaggcccgaccggcaggtccaggtccagccccggcctcgcgccggggctccatgctgggcctggccgcgtccttctcccgccgcaactcgctggtcgggccaggcgcgggtcctgggggtcagcggccatccctgggcccggtgccccctctgggctcaagggtcagcttctcagggttgcccctggcgcccgcccgttgggtggcgccctcctaccgcacggagccagtgcccggggagcgctgggaggctgcgcgtgcacagcgtgccctggaggcggcgctggccgcagggctgcacgacgcgtgctactccagcgacgaggccgcgcggctggtgcgggagctctgcgagcaggtgcacgttcgcctgcgcgagctcagcccgccacgctacaagctggtatgcagtgtggtgctggggccgcgcgcgggccagggcgttcacgtggtcagccgtgcgctctgggacgtggcgcgcgatgggctggcctcggtctcctacaccaacacctcgctcttcgcggtggccacggtccacgggctctactgcgagtgagggggagtccaattctgcaaaattgtttattatcctaggaggaggcccccctggggctcacatcccaataaataagtgtctgacaataaa

SEQ ID NO: 189901 - DNA, 1905 bp, Homo sapiens
  Payload ID: 17498
  Gene Symbol: TGDS
  Gene Name: TDP-glucose 4,6-dehydratase
  Uniprot ID: O95455
  ENST ID: ENST00000261296
  CDS Start-End: 122-1174
gcctctggctgctctgttaacgtgtcccgcgagcgaggcgcgtcgcaaaaggtcgcggcggaacttccctgcgcttttcagaccatactctttacggtactaggcactgctgagctgggagatgtcggcggcgtgttgggaggaaccgtggggtcttcccggcggctttgcgaagcgggtcctggtgaccggcggtgctggtttcattgcatcacatatgattgtctctttagtggaagattatccaaactatatgatcataaatctagacaagctggattactgtgcaagcttgaagaatcttgaaaccatttctaacaaacagaactacaaatttatacagggtgacatatgtgattctcactttgtgaaactgctttttgaaacagagaaaatagatatagtactacattttgccgcacaaacacatgtagatctttcattcgtacgtgcctttgagtttacctatgttaatgtttatggcactcacgttttggtaagtgctgctcatgaagccagagtggagaagtttatttatgtcagcacagatgaagtatatggtggcagtcttgataaggaatttgatgaatcttcacccaaacaacctacaaatccttatgcatcatctaaagcagctgctgaatgttttgtacagtcttactgggaacaatataagtttccagttgtcatcacaagaagcagtaatgtttatggaccacatcaatatccagaaaaggttattccaaaatttatatctttgctacagcacaacaggaaatgttgcattcatgggtcagggcttcaaacaagaaacttcctttatgctactgatgttgtagaagcatttctcactgtcctcaaaaaagggaaaccaggtgaaatttataacatcggaaccaattttgaaatgtcagttgtccagcttgccaaagaactaatacaactgatcaaagagaccaattcagagtctgaaatggaaaattgggttgattatgttaatgatagacccaccaatgacatgagatacccaatgaagtcagaaaaaatacatggcttaggatggagacctaaagtgccttggaaagaaggaataaagaaaacaattgaatggtacagagagaattttcacaactggaagaatgtggaaaaggcattagaaccctttccggtataatcaccatttatatagtcgagacagttgtcaaagaagaaagttatcctacctcgccaagtggtatgaaattaagtgaccaaatgaagtgcactcttttcttttggaattagattcatgactttctgtataaaattcaaatgcagaatgcctcaatctttgggagagtttcagtactggcatagaatttaaatgtcaaaattctttctgaaaccctttctcctagaaactaggaaataataggtgtagaagactctccctaagggtagccaggaagaagtctcctgattcggacaaccatgaggggtagtggtgctagggagaaggcaaccttcactggttttgaactcagtgcctaagaaagtctctgaaatgttcgtttttaggcaatataggatgtcttaggccctaattcaccatttcttttttaagatctgatatgctatcattgccttaataatggaacaaaatagaagcatatctaacactttttaaattgataattttgtaaaattgattacgttgaatgctttttaagagaagtgtgtaaagtttttatattttcacaattaacgtatgtaaaaccttgtatcagaaatttatcatgtttactgtttaaaatgattgtatttataaaattgtcaatatcttaatgtatttaatgtagaatattgctttttaaaataatgtttttattttgctgtagaaaaataaaaaaaaatttgattatatat

SEQ ID NO: 189902 - DNA, 3075 bp, Homo sapiens
  Payload ID: 17499
  Gene Symbol: TEAD1
  Gene Name: TEA domain family member 1 (SV40 transcriptional enhancer factor)
  Uniprot ID: P28347
  ENST ID: ENST00000334310
  CDS Start-End: 159-1232
tcgcagttaccaccaaacccaggaggagactctccctggaaaacttcccttccctttcggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggtaacaagcatggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtggg

SEQ ID NO: 189903 - DNA, 8158 bp, Homo sapiens
  Payload ID: 17499
  Gene Symbol: TEAD1
  Gene Name: TEA domain family member 1 (SV40 transcriptional enhancer factor)
  ENST ID: ENST00000361985
  CDS Start-End: 350-1435
agggagtgtggtggcattgctctgcagagacatgaacagctccctgggagacactgctggggaaagatgagtcgagtctacggttttttctcatcctcctgtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcgtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtgggaaacagcaaaacactaagcctgacctctcccaaattgggaagaccagaggagaaagtgcaaaactgtccccatttggaatgcccattccttctagaaaccagttggacagtgctcctctgcccttcataaacagactactgttgggtccctgattccaggctggcctgtgaaggattgccccaggtgtcccctttcacggttgtcacatttacagtgacttctgttgaacacccctcttagggatgtttcttttgctcttatttcctgcatctttccttaagggaagccccatcctctcccaggaccaggagtttatgaccaggcgagcacaaatggctaaaagccaagctgtcctagaacttcagtgggagagctgtctggttcatattctacccaggaatggtacttttcagtgcagccaggagggctcttgggatttcctttccaaagcacaaaaatactgggacccaagaagaacagctagaggacaactctgttggcacagagacggggacagcccagtctgctgacctcacagggtcagctgggcccccctggtgcttcaccacctgcatcctcttgctcagaatgcctttgcagttgagttttctgggtttctatgattgaccttgaggtttactccttgctcttacaacatttctaaggatttttaaaagtttacttcttgtcttgttcttctaaagctttctccaggacagatattttccctgtcttaaccactggtccagtcatcccagtgggcttctctttgtctctcccagattagacctttgggtgagattggcatcacaacatctaatctgagtctgtcttttgtccttcattctgtatggcagtctccctttgttataaaagctttctaaagcatactaaagaagccttcccagagccccgtcttgcttctcttccaggtgctctatcccctcgagaccctctggtgccaggcttgcttcacggccatcttgtgttgtcactgcagagtttggaggccagttttccacagcctaaacagggaggagctgcagaatggggctctggtctctgggcattcatttccctcatagaggctgagaataaaacaaggacttattcacacatgttctagaaccccagaatggcccaagttacctgagaccagggtttctcaaccttgacaccattgacattttggactgggtaattctttgttctgcagagctgtcctttgcactgtaggagatttactaatatccctggcctctacccagtagtaccactagcacctattccccacccagcgtgtctccagatattgtcaaatatcccatcgggtgcaaaatgatccctggtcaagatctgttgcccaagatgttacaggtcacaatgaccacatttgaaattgttttccctttcattttaccctgtgaaagcatctctcctagagccttgcaagaggcaggtgacattgtgtccatatttcttcctgtttcagaacttctgtttcacaacaatttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgac

SEQ ID NO: 189904 - DNA, 477 bp, Homo sapiens
  Payload ID: 17499
  Gene Symbol: TEAD1
  Gene Name: TEA domain family member 1 (SV40 transcriptional enhancer factor)
  ENST ID: ENST00000527376
  CDS Start-End: 1-477
gtgacgcccccccacccctccacctttgcccggagcgcgggcagcagcccagcgcgccagccggccccggggcaggagcggtgctaggcaggggtggggtggccgggcccagggaccgggagccggggagggagccgggcaccgagcagagggcgggggaagcggcgccgaagtttgcctcggactcgccgggcgctgcggtggctccctgggccgaggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggta

SEQ ID NO: 189905 - DNA, 2544 bp, Homo sapiens
  Payload ID: 17499
  Gene Symbol: TEAD1
  Gene Name: TEA domain family member 1 (SV40 transcriptional enhancer factor)
  ENST ID: ENST00000527636
  CDS Start-End: 452-1732
ggccgcgtccaggcacaggccatgcagtgacgcccccccacccctccacctttgcccggagcgcgggcagcagcccagcgcgccagccggccccggggcaggagcggtgctaggcaggggtggggtggccgggcccagggaccgggagccggggagggagccgggcaccgagcagagggcgggggaagcggcgccgaagtttgcctcggactcgccgggcgctgcggtggctccctgggccgaggactgttgctgccgctgccgccgccgcttcattgcacattcaagtggaaaattttcaggagtcagcagaaacattgtgtccaaaaaagactgagtcgcagttaccaccaaacccaggaggagactctccctggaaaacttcccttccctttcggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcgtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatg

SEQ ID NO: 189906 - DNA, 8477 bp, Homo sapiens
  Payload ID: 17499
  Gene Symbol: TEAD1
  Gene Name: TEA domain family member 1 (SV40 transcriptional enhancer factor)
  ENST ID: ENST00000526600
  CDS Start-End: 224-1216
tgagaggcttcacattctgttggaaaatggatttaatccctaaaaaaagccttgccccattgggtcttcccagtaaatgttgagaggtacggtaggttgagtgtggtttagccttctggctgtgttatttatccatgcatgtttgctttttttggcctattttgtggctctgtattttagtccatgtgctcgtggctgtgcctgtgtaacctgcctggtagccatgcgttatgtattaagttggtgtgtcactgtcaccttcaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcgtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtgggaaacagcaaaacactaagcctgacctctcccaaattgggaagaccagaggagaaagtgcaaaactgtccccatttggaatgcccattccttctagaaaccagttggacagtgctcctctgcccttcataaacagactactgttgggtccctgattccaggctggcctgtgaaggattgccccaggtgtcccctttcacggttgtcacatttacagtgacttctgttgaacacccctcttagggatgtttcttttgctcttatttcctgcatctttccttaagggaagccccatcctctcccaggaccaggagtttatgaccaggcgagcacaaatggctaaaagccaagctgtcctagaacttcagtgggagagctgtctggttcatattctacccaggaatggtacttttcagtgcagccaggagggctcttgggatttcctttccaaagcacaaaaatactgggacccaagaagaacagctagaggacaactctgttggcacagagacggggacagcccagtctgctgacctcacagggtcagctgggcccccctggtgcttcaccacctgcatcctcttgctcagaatgcctttgcagttgagttttctgggtttctatgattgaccttgaggtttactccttgctcttacaacatttctaaggatttttaaaagtttacttcttgtcttgttcttctaaagctttctccaggacagatattttccctgtcttaaccactggtccagtcatcccagtgggcttctctttgtctctcccagattagacctttgggtgagattggcatcacaacatctaatctgagtctgtcttttgtccttcattctgtatggcagtctccctttgttataaaagctttctaaagcatactaaagaagccttcccagagccccgtcttgcttctcttccaggtgctctatcccctcgagaccctctggtgccaggcttgcttcacggccatcttgtgttgtcactgcagagtttggaggccagttttccacagcctaaacagggaggagctgcagaatggggctctggtctctgggcattcatttccctcatagaggctgagaataaaacaaggacttattcacacatgttctagaaccccagaatggcccaagttacctgagaccagggtttctcaaccttgacaccattgacattttggactgggtaattctttgttctgcagagctgtcctttgcactgtaggagatttactaatatccctggcctctacccagtagtaccactagcacctattccccacccagcgtgtctccagatattgtcaaatatcccatcgggtgcaaaatgatccctggtcaagatctgttgcccaagatgttacaggtcacaatgaccacatttgaaattgttttccctttcattttaccctgtgaaagcatctctcctagagccttgcaagaggcaggtgacattgtgtccatatttcttcctgtttcagaacttctgtttcacaacaatttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgt

SEQ ID NO: 189907 - DNA, 3063 bp, Homo sapiens
  Payload ID: 17499
  Gene Symbol: TEAD1
  Gene Name: TEA domain family member 1 (SV40 transcriptional enhancer factor)
  ENST ID: ENST00000527575
  CDS Start-End: 114-1220
tcgcagttaccaccaaacccaggaggagactctccctggaaaacttcccttccctttcggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtggg

SEQ ID NO: 189908 - DNA, 2164 bp, Homo sapiens
  Payload ID: 17500
  Gene Symbol: TEAD2
  Gene Name: TEA domain family member 2
  Uniprot ID: Q15562
  ENST ID: ENST00000311227
  CDS Start-End: 92-1435
cccacttttcccaaacaaagctcccggcaactttctccctcgcagcgccccgcccgcccgcggctccccagccccaggccgggaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaa

SEQ ID NO: 189909 - DNA, 2440 bp, Homo sapiens
  Payload ID: 17500
  Gene Symbol: TEAD2
  Gene Name: TEA domain family member 2
  Uniprot ID: Q15562
  ENST ID: ENST00000377214
  CDS Start-End: 364-1716
cttctcctccctcagactcaggagtccagaccccagccccttctccctcacacccaggagtccaggcctccagcccccgctccctcagacccaggagtccaggccccagatcctcctccctcagtcctaggagtccgggccccagcccctcctccctcagactcaggagttcaggccccagatcctcctccctcagacccaggaataccccccagctcctcttccctcagacccaggagtccaggtccccagcccctcctccctcagacccagtggtccagagtcccagccctctcagcttcaagtcccttgagggtggggtttgggggaagcttgctgagttctgtgttcctccaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggtggtccaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttacc

SEQ ID NO: 189910 - DNA, 1444 bp, Homo sapiens
  Payload ID: 17500
  Gene Symbol: TEAD2
  Gene Name: TEA domain family member 2
  Uniprot ID: Q15562
  ENST ID: ENST00000539846
  CDS Start-End: 243-1202
aaagctcccggcaactttctccctcgcagcgccccgcccgcccgcggctccccagccccaggccgggaggtcggaatgaactgatcgcccgctacatcaagctgagaacggggaagacccgaactcgaaaacaggtttctagtcacatccaggttttggcccgaaggaaatcaagggaaatccagtccaagttgaaggctctgaacgtggaccaggtttccaaggacaaggctttccagacaatggcaaccatgtcctctgcccagctcatctccgcgccttctctgcaggccaaactgggtcccactggtcctcaggtggtccaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctg

SEQ ID NO: 189911 - DNA, 2141 bp, Homo sapiens
  Payload ID: 17500
  Gene Symbol: TEAD2
  Gene Name: TEA domain family member 2
  Uniprot ID: Q15562
  ENST ID: ENST00000593945
  CDS Start-End: 57-1412
aggccgggaggtaggaaggcgccggcgggagtcggggatcctgctttggggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggctctgaacgtggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaa

SEQ ID NO: 189912 - DNA, 2167 bp, Homo sapiens
  Payload ID: 17500
  Gene Symbol: TEAD2
  Gene Name: TEA domain family member 2
  Uniprot ID: Q15562
  ENST ID: ENST00000601519
  CDS Start-End: 86-1438
cgcccgcccgcggctccccagccccaggccgggaggtaggaaggcgccggcgggagtcggggatcctgctttggggtgtgcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggtggtccaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaa

SEQ ID NO: 189913 - DNA, 566 bp, Homo sapiens
  Payload ID: 17500
  Gene Symbol: TEAD2
  Gene Name: TEA domain family member 2
  ENST ID: ENST00000598823
  CDS Start-End: 1-223
gaaggaccaggtttccaaggacaaggctttccagacaatggcaaccatgtcctctgcccagctcatctccgcgccttctctgcaggccaaactgggtcccactggtcctcaggtggtccaggcctctgagcttttccagttttggtctggaggatctgggcccccctggaatgttccagagaagaaactccttcccagaagccccccagcagatttcccctaacgtctcattggctaggactgtgtcacatggccacttctaactgcaagggaggctgggaaaggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtgg

SEQ ID NO: 189914 - DNA, 2191 bp, Homo sapiens
  Payload ID: 17500
  Gene Symbol: TEAD2
  Gene Name: TEA domain family member 2
  Uniprot ID: Q15562
  ENST ID: ENST00000598810
  CDS Start-End: 107-1462
tgatggcagggcgcccctgtcccccagcttgtggttctgtgggtctctcctggtctcggcctcagctgctgccctgagtctctgtccctgccctttctaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggctctgaacgtggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaa

SEQ ID NO: 189915 - DNA, 579 bp, Homo sapiens
  Payload ID: 17500
  Gene Symbol: TEAD2
  Gene Name: TEA domain family member 2
  ENST ID: ENST00000596757
  CDS Start-End: 231-579
aaagctcccggcaactttctccctcgcagcgccccgcccgcccgcggctccccagccccaggccgggaggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccaga

SEQ ID NO: 189916 - DNA, 2983 bp, Homo sapiens
  Payload ID: 17501
  Gene Symbol: TEAD3
  Gene Name: TEA domain family member 3
  Uniprot ID: Q99594
  ENST ID: ENST00000338863
  CDS Start-End: 229-1536
acaaactttccgtcccgctcgctccctcctccgcgctcggcgcctcccgctccagcccggctcattccgcacattccggccagccccctccccacgaccccccttccccggccccccttgcggctccctcgggcccggcggagcggcccggccggagcgcccccgcgagctcggaccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcggccggcggaagatcatcctgtcagacgagggcaagatgtacggccgaaatgagttgattgcacgctatattaaactgaggacggggaagactcggacgagaaaacaggtgtccagccacatacaggttctagctcggaagaaggtgcgggagtaccaggttggcatcaaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcaggcccaggacccaggaggcctccccacctaccccagcacacacactccctgccactgttctgcgctttaattgtgggagaagagaggagaggagggctcagcggtggggcagcctgtccggggcgctgacccaccatcaccctgctctgcccagcctcgcgtgacctcagagaggtggggataggggacaccttcagcctccagcatgtgtggccactgtacccccacccacccttgggggagcatgatgggcaggtgagggcaggatggagaccaagggagtcagtgagcagaggccctgggagtgtccggttggggttggactgaggacagaggggcccacacttccttgcccctttgtgtcccaggcctggtgcccagactccttgcatggcttgtgtggtcctcagactccgcacagcgagcgtaggtctctgggtttcagatgaagtgcccaggctccaggaagttgagggacccacaggagaggtgggcagagctggagttctcatccagggctgcttgtccccagagcccaggtttatactacctccctggggcgggggctggccgcagggtaggggagaggctctgcagtgtggagtggagcctcatcgaggggcgctgggttaggggagcacctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaaaaaaaaattaaagttatttgtttgtgggtcagtcatgtaa

SEQ ID NO: 189917 - DNA, 2729 bp, Homo sapiens
  Payload ID: 17501
  Gene Symbol: TEAD3
  Gene Name: TEA domain family member 3
  ENST ID: ENST00000402886
  CDS Start-End: 155-1282
cctcgggcccggcggagcggcccggccggagcgcccccgcgagctcggaccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcggccggcggaagatcatcctgtcagacgagggcaagatgtacggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcaggcccaggacccaggaggcctccccacctaccccagcacacacactccctgccactgttctgcgctttaattgtgggagaagagaggagaggagggctcagcggtggggcagcctgtccggggcgctgacccaccatcaccctgctctgcccagcctcgcgtgacctcagagaggtggggataggggacaccttcagcctccagcatgtgtggccactgtacccccacccacccttgggggagcatgatgggcaggtgagggcaggatggagaccaagggagtcagtgagcagaggccctgggagtgtccggttggggttggactgaggacagaggggcccacacttccttgcccctttgtgtcccaggcctggtgcccagactccttgcatggcttgtgtggtcctcagactccgcacagcgagcgtaggtctctgggtttcagatgaagtgcccaggctccaggaagttgagggacccacaggagaggtgggcagagctggagttctcatccagggctgcttgtccccagagcccaggtttatactacctccctggggcgggggctggccgcagggtaggggagaggctctgcagtgtggagtggagcctcatcgaggggcgctgggttaggggagcacctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaaaaaaaaattaaagttatttgtttgtgggtcagtcatgtaa

SEQ ID NO: 189918 - DNA, 657 bp, Homo sapiens
  Payload ID: 17501
  Gene Symbol: TEAD3
  Gene Name: TEA domain family member 3
  ENST ID: ENST00000433586
  CDS Start-End: 1-657
gtctctagccacttgcaagttctagccaggcggaaatctcgggagattcagtctaagctgaaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccag

SEQ ID NO: 189919 - DNA, 1637 bp, Homo sapiens
  Payload ID: 17502
  Gene Symbol: TEAD4
  Gene Name: TEA domain family member 4
  ENST ID: ENST00000358409
  CDS Start-End: 275-1450
gtggccccgccgccactccctccggctccctccctcccgccgcggcgcgcatctcattccagccctcattccgcgcattccagcgtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaagttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgta

SEQ ID NO: 189920 - DNA, 1690 bp, Homo sapiens
  Payload ID: 17502
  Gene Symbol: TEAD4
  Gene Name: TEA domain family member 4
  ENST ID: ENST00000359864
  CDS Start-End: 191-1495
gtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgtattttcaga

SEQ ID NO: 189921 - DNA, 1396 bp, Homo sapiens
  Payload ID: 17502
  Gene Symbol: TEAD4
  Gene Name: TEA domain family member 4
  Uniprot ID: Q15561
  ENST ID: ENST00000397122
  CDS Start-End: 286-1203
tctgcgcgctgacgccctgtcgtccccgcagaacgatcgccgcggccggaagagttggcgctcggggcggactccttggaactggcttagcgcacccatcccaccttcccgcaccctgggaccggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgtattttca

SEQ ID NO: 189922 - DNA, 641 bp, Homo sapiens
  Payload ID: 17502
  Gene Symbol: TEAD4
  Gene Name: TEA domain family member 4
  ENST ID: ENST00000443986
  CDS Start-End: 127-459
gcagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtctccagccacatccaggtgctggctcgtcgcaaagctcgcgagatccaggccaagctaaagttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagc

SEQ ID NO: 189923 - DNA, 570 bp, Homo sapiens
  Payload ID: 17502
  Gene Symbol: TEAD4
  Gene Name: TEA domain family member 4
  ENST ID: ENST00000536826
  CDS Start-End: 354-570
ttccagcgtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtaaggctggggcgcggggacttggtaggactttgccggagggcaggagtctgcgcggtgcgtgcggagctccctcccgggacgagactgggaagagcgaggcacgtggaggcggcgcgactgaggctgctggaggcgaagcggctccaggggcgggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggca

SEQ ID NO: 189924 - DNA, 578 bp, Homo sapiens
  Payload ID: 17502
  Gene Symbol: TEAD4
  Gene Name: TEA domain family member 4
  ENST ID: ENST00000540314
  CDS Start-End: 512-578
attccagcgtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtaaggctggggcgcggggacttggtaggactttgccggagggcaggagtctgcgcggtgcgtgcggagctccctcccgggacgagactgggaagagcgaggcacgtggaggcggcgcgactgaggctgctggaggcgaagcggctccaggggcgggtaaggggggtggacactcgggactttgggggaaagggaggccggtgtggaaaggaccggagaggcagaaccgagagcatcggcaacagaagagacccagcacccatgcctcttttctgctgggcccttttcgagcctggaagggagagacctggaggtccaacgagcgctcctccaagcggagccttggagggcacggccggcaccattacctccaacgagtggagctctcccacctcccctgaggggagca

SEQ ID NO: 189925 - DNA, 567 bp, Homo sapiens
  Payload ID: 17502
  Gene Symbol: TEAD4
  Gene Name: TEA domain family member 4
  ENST ID: ENST00000544666
  CDS Start-End: 1-567
agggaagacccgcaccaggaagcaggtctccagccacatccaggtgctggctcgtcgcaaagctcgcgagatccaggccaagctaaagacaggtgctgagctaggcacctgtggtagagaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacat

SEQ ID NO: 189926 - DNA, 801 bp, Homo sapiens
  Payload ID: 17502
  Gene Symbol: TEAD4
  Gene Name: TEA domain family member 4
  ENST ID: ENST00000543035
  CDS Start-End: 275-801
cctccctccgcgcgctccgctccgctccgctgggcgcaccggggccggtcggcgcggggtgggcttggccccgcggccccgccttcactgcgccgcccgtcggccccggccggagcccggctctgcgcgctgacgccctgtcgtccccgcagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatga

SEQ ID NO: 189927 - DNA, 4992 bp, Homo sapiens
  Payload ID: 17503
  Gene Symbol: TSHZ1
  Gene Name: teashirt zinc finger homeobox 1
  Uniprot ID: Q6ZSZ6
  ENST ID: ENST00000322038
  CDS Start-End: 585-3683
aaaaactgaagcaggaaaagcagctcgatgtgtctgtctatcagttgagactgtctgaaagctctgcgatccgaatgtgtgttatatttcactgaaaagaggagagagcgagagtgcatctccctctctcccaggagtttgagggggggggggacagtccacgctcatctcgcccacccagtgaatgtctgctcttcaccccctttgcacacactctccgggttgttgttgccttttttttttcttggaggggggggtgctttttgtgtatttttcaaatttttttctgttggaagatcaagaccggccaaaaatccatgatcaaaatgtgtttgcattagatttcgcattggaagaagcggcgatcctggcggccaagccccccgggtggaagcgcggggcaccaagtggcgctccggcggggtgacactgtttgatctgtgactgtttggaaggtggagcagcgcctgacatctccccccggcgcatcttatgttcctgaggaagaattgaaggcagcagaaatagatgaagagcacgtggaggatgacgggctgtctttggacattcaggaaagtgagtacatgtgcaatgaagagacggagatcaaagaggcgcagagctaccagaactccccagtcagctctgcgactaaccaggacgccggctacgggtcgcccttcagtgagagcagcgaccagctagcccatttcaaaggctcttcctctcgagaagagaaggaggatccgcagtgtcccgacagcgtctcgtacccccaggacagcctggcacagatcaaagctgtgtatgcaaacttgttctccgagtcctgctggtccagcttagctctggatttaaagaagtcgggttccaccaccagcaccaacgatgccagccagaaggagagctccgcccccacccccacaccccccacctgccccgtcagcaccactggccccaccacgagcacgcccagcaccagctgcagctccagcaccagccacagcagtaccaccagtaccagcagcagctccgggtacgactggcaccaggctgcactggccaagacgctgcagcagacgtcctcgtatgggctgcttcctgagcccagcctgttcagcaccgtgcagctctaccgccagaacaacaagctctacggctccgtcttcacgggcgccagcaagttccggtgcaaagactgcagtgccgcgtacgacacgctggtggaactgacggtgcacatgaacgagacaggccactaccgtgacgacaacagggacaaggactccgagaagaccaagaggtggtccaagcccaggaagcgctccctgatggagatggaggggaaggaggatgcccagaaggtgctgaagtgcatgtactgtggacactcctttgagtccttgcaggacctcagcgtccacatgatcaaaaccaagcattaccagaaagtgcctctgaaggagccagtgccagccatcaccaaactggtcccctccaccaaaaagcgggcgcttcaggacctggcgcccccctgctcccctgagccagcaggaatggccgcagaggtggccctgagtgagtcagccaaggatcagaaagcagcgaacccgtacgtcacgcccaataaccgctatggctaccagaatggcgccagctacacctggcagtttgaggcccgcaaggcgcagatcctcaagtgcatggagtgtggcagctcccacgacacgctgcagcagctcaccgcccacatgatggtcaccgggcacttcctgaaagtgaccacctcggcttctaagaagggcaagcagttggtgctggaccctgtggtggaagagaagatccagtccatcccactaccgcccaccacccacacgcggctgccggcctccagcatcaaaaagcagcccgactctcccgcggggtccacgacttctgaagaaaagaaagagccagagaaggagaagccgcctgtggctggcgacgcggagaagatcaaggaggagagtgaggacagcttggagaaatttgagcccagcaccctgtacccgtacctgcgtgaggaggacctggacgacagccccaagggagggctggacattctcaagtccctggagaataccgtctccacggccattagcaaagctcagaatggtgcgccctcatggggtggctaccccagcatccatgcagcctaccagctcccgggcaccgtgaagccactgccggcggccgtgcagagcgtgcaggtgcagccgtcctatgctggcggcgtgaagtcgctgtcttccgccgagcacaacgccctcctgcactccccagggagcctcacgcccccaccgcacaagagcaacgtgtctgccatggaggagctggtggagaaggtcacgggcaaggtcaacatcaagaaggaggagagaccccctgagaaggagaagagctccctggccaaggctgcgtcccccatagcaaaagagaataaagatttcccgaaaacggaggaagtcagcggcaaaccacagaagaagggccctgaggccgagactgggaaggccaaaaaggagggaccgctggacgttcacaccccaaatggcacagagcctctcaaagcaaaggtcaccaacggctgtaacaacctggggatcatcatggaccactcaccggagccttccttcatcaacccgctgagcgctttgcagtccatcatgaacacccacctgggcaaggtgtccaagcccgtgagtccctcgctggacccgctggcgatgctgtacaagatcagcaacagcatgctggacaagccggtgtaccccgccacccctgtgaagcaggccgatgccatcgaccgctactattatgaaaacagcgaccagcccattgacttaaccaagtccaagaacaagccgctggtgtccagcgtggctgattcggtggcatcacctctgcgggagagcgcactcatggacatctccgacatggtgaaaaacctcacaggccgcctgacgcccaagtcctccacgccctccacagtttcagagaagtccgatgctgatggcagcagctttgaggaggcgttggacgagctgtcaccggtccacaagaggaagggccggcagtccaactggaacccgcagcaccttctcatcctgcaggcccagttcgcctcgagcttgcgggagaccacagagggcaagtacatcatgtcggacttgggcccgcaggagagggtgcacatctcgaagtttactgggctctccatgaccaccatcagccactggctggccaatgtgaagtaccagttgaggaggacagggggaacgaaattcctaaagaacctggacacagggcatcctgttttcttttgcaacgattgtgcctctcagttcagaactgcttctacatacataagtcatttggagacacacttgggcttcagcctgaaggatctctccaagctgccactcaatcagattcaagaacagcagaatgtttcgaaagtcctcaccaacaaaactctgggcccactgggggccaccgaggaagacttgggctccacattccaatgtaagctctgcaaccggacttttgcgagcaagcacgcagtcaaactgcaccttagtaagacccacggcaagtctcccgaggaccacctgatctatgtgactgagttggagaaacagtagcgtccaggtatgcaagagaccgcggaacattgcactaaacgtcgtcgagctgcactaggcctggcctgagcctctgaaatcagtctttcctttgttgctggcccgcctctctggaccttggttttcttacacatattttgtatatttatatgctctctgtccgatctgtgcatgttatttttctttttccgtgagtcaaagtctgacctttattttcaacatctgttcttggtgttaagctatcttttgtaggaaatagtggggcacactactcagagacattatttagcagtaaagaaagacacaaataacaatgataaaaagacatcctaaaatggtgaagttgccatgacaataaaggtcatagaacctggtagtgtcaaatttaaccctttgaggactgtaattgcatttctgtgcctttcacttgaaaaaaaaaaaagaagaaaaaaaggcttaaaggcatttcattcagatcaaaagctgtgtcagacacaaaacttatttaataattaaaaaatgagcttttatatgcagaactggtttgtgaggaaacatgcatgcagctgtgggaagatagaaagctgtctaggactcacggggttcggaagccacacctctacatgtctaaaacaaaaaacaacaacaacagataccccactcgccactatgcccaaaccctctggatgctgaaaaatgccactttcggcaaaaaaaaaagtatgcaagctattatttaaaaatgtgtaaaaatgctatttcttttttcctgtaaaatattgcagtttatagttatttacaaatgtaagctttggtacaagctgacctttctatagcgtgctgcattggtaaatgaaaaaaaatggggcaaacgttggagtcctttccttgtaaattgccagcatcagcttaaaaactcctgtatgttacatatcgtaccattttaatctcttcaactttctttgtaccttctggctgtatgctttctcttttaactttttatattgtcattttatattaaatttctgtgtatataatgtaaaaccacaatttttgaataaaatttagttcctgcagcttgatttaaatagaggacttttactggcacctgcatctctccagatgcatgtactcagagggactgtcagacaaaaataaatacataaaaacaaagcaagcaatgcactattaattatacattttgatgttctatcattaatattgtacagtacattttggttcacacaattaaatccactgttttctcagatgtaaaataaacccacatgcagttcttgatttacacgga

SEQ ID NO: 189928 - DNA, 551 bp, Homo sapiens
  Payload ID: 17503
  Gene Symbol: TSHZ1
  Gene Name: teashirt zinc finger homeobox 1
  ENST ID: ENST00000560661
  CDS Start-End: 316-551
gaccaggccggctttctccagtgcggttgggccggaaccccgggatggtaaaaaagaaaaatgcatggaggagttgaactccacattggtatttttagaagttggatgcgggaaatagccagtgccacctgaagctgtggaaacaaacaggagcttggactttgcaggcatacctctttttaaagtgaagacattttcaggaacccctggatttttaaggcttatgttcctgaggaagaattgaaggcagcagaaatagatgaagagcacgtggaggatgacgggctgtctttggacattcaggaaagtgagtacatgtgcaatgaagagacggagatcaaagaggcgcagagctaccagaactccccagtcagctctgcgactaaccaggacgccggctacgggtcgcccttcagtgagagcagcgaccagctagcccatttcaaaggctcttcctctcgagaagagaaggaggatccgcagtgtcccgacagcgtctcgtacccccaggacagcctggcacagatcaaagctgtgtatgcaaacttgtt

SEQ ID NO: 189929 - DNA, 1022 bp, Homo sapiens
  Payload ID: 17503
  Gene Symbol: TSHZ1
  Gene Name: teashirt zinc finger homeobox 1
  ENST ID: ENST00000560918
  CDS Start-End: 193-1022
agcccgcgttagccatctacatactgaatcggatgtgcacttccaaatttgagatgtaggcatttctgcctcaacttgctagctgcgattttaaaagcttatgttcctgaggaagaattgaaggcagcagaaatagatgaagagcacgtggaggatgacgggctgtctttggacattcaggaaagtgagtacatgtgcaatgaagagacggagatcaaagaggcgcagagctaccagaactccccagtcagctctgcgactaaccaggacgccggctacgggtcgcccttcagtgagagcagcgaccagctagcccatttcaaaggctcttcctctcgagaagagaaggaggatccgcagtgtcccgacagcgtctcgtacccccaggacagcctggcacagatcaaagctgtgtatgcaaacttgttctccgagtcctgctggtccagcttagctctggatttaaagaagtcgggttccaccaccagcaccaacgatgccagccagaaggagagctccgcccccacccccacaccccccacctgccccgtcagcaccactggccccaccacgagcacgcccagcaccagctgcagctccagcaccagccacagcagtaccaccagtaccagcagcagctccgggtacgactggcaccaggctgcactggccaagacgctgcagcagacgtcctcgtatgggctgcttcctgagcccagcctgttcagcaccgtgcagctctaccgccagaacaacaagctctacggctccgtcttcacgggcgccagcaagttccggtgcaaagactgcagtgccgcgtacgacacgctggtggaactgacggtgcacatgaacgagacaggccactaccgtgacgacaacagggacaaggactccgagaagaccaagaggtggtccaagcccaggaagcgctccctgatggagatggaggggaaggaggatgcccagaaggtgctgaagtgcatgtactgtggacactcctttgagtccttgcaggacct

SEQ ID NO: 189930 - DNA, 3582 bp, Homo sapiens
  Payload ID: 17503
  Gene Symbol: TSHZ1
  Gene Name: teashirt zinc finger homeobox 1
  Uniprot ID: Q6ZSZ6
  ENST ID: ENST00000580243
  CDS Start-End: 349-3582
gcatggagcgcgggccgcgggccggcccgccgagcgcccgctgctgcgcccgcggcccgcgccggggatgactccgggctcggcgcccaggccccgcgcgctccgcccgcagcccggcgccgggaagcgggccgcgcggccgccgccgccgcctcctgagcggccccgggcgcggcggtccatgcgagcggctccccgcggtccgcggcgcgcccggagcccggagcccgcggggacgaggccaaagttgggcgcgccgcggagttgcgcccgcgcccggggccccgcgtccccgcgccccgcgaactccggcggcggctgaggcgacggctgcggcggccgagcagcatgccgaggaggaagcagcaggccccccggcgctcggcagcttatgttcctgaggaagaattgaaggcagcagaaatagatgaagagcacgtggaggatgacgggctgtctttggacattcaggaaagtgagtacatgtgcaatgaagagacggagatcaaagaggcgcagagctaccagaactccccagtcagctctgcgactaaccaggacgccggctacgggtcgcccttcagtgagagcagcgaccagctagcccatttcaaaggctcttcctctcgagaagagaaggaggatccgcagtgtcccgacagcgtctcgtacccccaggacagcctggcacagatcaaagctgtgtatgcaaacttgttctccgagtcctgctggtccagcttagctctggatttaaagaagtcgggttccaccaccagcaccaacgatgccagccagaaggagagctccgcccccacccccacaccccccacctgccccgtcagcaccactggccccaccacgagcacgcccagcaccagctgcagctccagcaccagccacagcagtaccaccagtaccagcagcagctccgggtacgactggcaccaggctgcactggccaagacgctgcagcagacgtcctcgtatgggctgcttcctgagcccagcctgttcagcaccgtgcagctctaccgccagaacaacaagctctacggctccgtcttcacgggcgccagcaagttccggtgcaaagactgcagtgccgcgtacgacacgctggtggaactgacggtgcacatgaacgagacaggccactaccgtgacgacaacagggacaaggactccgagaagaccaagaggtggtccaagcccaggaagcgctccctgatggagatggaggggaaggaggatgcccagaaggtgctgaagtgcatgtactgtggacactcctttgagtccttgcaggacctcagcgtccacatgatcaaaaccaagcattaccagaaagtgcctctgaaggagccagtgccagccatcaccaaactggtcccctccaccaaaaagcgggcgcttcaggacctggcgcccccctgctcccctgagccagcaggaatggccgcagaggtggccctgagtgagtcagccaaggatcagaaagcagcgaacccgtacgtcacgcccaataaccgctatggctaccagaatggcgccagctacacctggcagtttgaggcccgcaaggcgcagatcctcaagtgcatggagtgtggcagctcccacgacacgctgcagcagctcaccgcccacatgatggtcaccgggcacttcctgaaagtgaccacctcggcttctaagaagggcaagcagttggtgctggaccctgtggtggaagagaagatccagtccatcccactaccgcccaccacccacacgcggctgccggcctccagcatcaaaaagcagcccgactctcccgcggggtccacgacttctgaagaaaagaaagagccagagaaggagaagccgcctgtggctggcgacgcggagaagatcaaggaggagagtgaggacagcttggagaaatttgagcccagcaccctgtacccgtacctgcgtgaggaggacctggacgacagccccaagggagggctggacattctcaagtccctggagaataccgtctccacggccattagcaaagctcagaatggtgcgccctcatggggtggctaccccagcatccatgcagcctaccagctcccgggcaccgtgaagccactgccggcggccgtgcagagcgtgcaggtgcagccgtcctatgctggcggcgtgaagtcgctgtcttccgccgagcacaacgccctcctgcactccccagggagcctcacgcccccaccgcacaagagcaacgtgtctgccatggaggagctggtggagaaggtcacgggcaaggtcaacatcaagaaggaggagagaccccctgagaaggagaagagctccctggccaaggctgcgtcccccatagcaaaagagaataaagatttcccgaaaacggaggaagtcagcggcaaaccacagaagaagggccctgaggccgagactgggaaggccaaaaaggagggaccgctggacgttcacaccccaaatggcacagagcctctcaaagcaaaggtcaccaacggctgtaacaacctggggatcatcatggaccactcaccggagccttccttcatcaacccgctgagcgctttgcagtccatcatgaacacccacctgggcaaggtgtccaagcccgtgagtccctcgctggacccgctggcgatgctgtacaagatcagcaacagcatgctggacaagccggtgtaccccgccacccctgtgaagcaggccgatgccatcgaccgctactattatgaaaacagcgaccagcccattgacttaaccaagtccaagaacaagccgctggtgtccagcgtggctgattcggtggcatcacctctgcgggagagcgcactcatggacatctccgacatggtgaaaaacctcacaggccgcctgacgcccaagtcctccacgccctccacagtttcagagaagtccgatgctgatggcagcagctttgaggaggcgttggacgagctgtcaccggtccacaagaggaagggccggcagtccaactggaacccgcagcaccttctcatcctgcaggcccagttcgcctcgagcttgcgggagaccacagagggcaagtacatcatgtcggacttgggcccgcaggagagggtgcacatctcgaagtttactgggctctccatgaccaccatcagccactggctggccaatgtgaagtaccagttgaggaggacagggggaacgaaattcctaaagaacctggacacagggcatcctgttttcttttgcaacgattgtgcctctcagttcagaactgcttctacatacataagtcatttggagacacacttgggcttcagcctgaaggatctctccaagctgccactcaatcagattcaagaacagcagaatgtttcgaaagtcctcaccaacaaaactctgggcccactgggggccaccgaggaagacttgggctccacattccaatgtaagctctgcaaccggacttttgcgagcaagcacgcagtcaaactgcaccttagtaagacccacggcaagtctcccgaggaccacctgatctatgtgactgagttggagaaacagtag

SEQ ID NO: 189931 - DNA, 3093 bp, Homo sapiens
  Payload ID: 17504
  Gene Symbol: TSHZ2
  Gene Name: teashirt zinc finger homeobox 2
  Uniprot ID: Q9NRE2
  ENST ID: ENST00000329613
  CDS Start-End: 1-3093
atgatggctgctgcgttgctccattatacaggctacgcccaggaggaacagctgaaagaagaggaggaaataaaagaagaggaggaggaggaggacagcggttcagtagctcaactgcagggtggcaatgacacagggacggacgaggagctagaaacgggcccagagcaaaaaggctgcttcagctaccagaactctccaggaagtcatttgtccaatcaggatgccgagaacgagtctctgctgagtgacgccagtgatcaggtgtcggacatcaagagtgtctgcggcagagatgcctcagacaagaaagcacacactcacgtcaggcttccaaacgaagcacacaattgcatggataaaatgaccgctgtctacgccaacatcctgtcggattcctactggtcaggcctgggccttggcttcaagctgtccaatagtgagaggaggaactgtgacacccgaaacggcagcaacaagagtgattttgattggcaccaagacgctctgtccaaaagcctgcagcagaacttgccttctcggtccgtctcgaaacccagcctgttcagctcggtgcagttgtaccgacagagcagcaagatgtgcgggactgtgttcacaggggccagcagattccgatgccgacagtgcagcgcggcctatgacaccctagtcgagctgactgtgcacatgaatgaaacgggccactatcaagatgacaaccgcaaaaaggacaagctcagacccacgagctattcaaagcccaggaaaagggctttccaggatatggacaaagaggatgctcaaaaggttctgaaatgtatgttttgtggcgactcctttgattccctccaagatttgagcgtccacatgattaaaacaaaacattaccaaaaagtgcctttgaaggagccagtcccaaccatttcctcgaaaatggtcaccccggctaagaaacgcgtttttgatgtcaatcggccgtgttcccccgattcaaccacaggatcttttgcagattctttttcttctcagaagaacgccaacttgcagttgtcctccaacaaccgctatggctaccaaaatggagccagctacacctggcagtttgaggcctgcaagtcccagatcttaaagtgcatggagtgtgggagctcccatgacaccttgcagcagctcaccacccacatgatggtcacaggtcactttctcaaggtcaccagctctgcctccaagaaagggaagcagctggtattagacccgttagcagtggagaaaatgcagtcgttgtctgaggccccaaacagtgattctctggctcccaagccatccagtaactcagcatcagattgtacagcctctacaactgagttaaagaaagagagtaaaaaagaaaggccagaggaaaccagcaaggatgagaaagtcgtgaaaagcgaggactatgaagatcctctacaaaaacctttagaccctacaatcaaatatcaatacctaagggaggaagacttggaagatggctcaaagggtggaggggacattttgaaatctttggaaaatactgtcaccacagccatcaacaaagcccaaaacggggcccccagctggagtgcctaccccagcatccacgcagcctaccagctgtctgagggcaccaagccgcctttgcctatgggatcccaggtactgcagatccggcctaatctcaccaacaagctgaggcccattgcaccaaagtggaaagtgatgccactggtttctatgcccacacacctggccccttacactcaagtcaagaaagagtcagaagacaaagatgaagcggtgaaggagtgtgggaaagaaagtccccacgaagaggcctcatctttcagccacagtgagggcgattctttccgcaaaagtgaaacacctccagaagccaaaaagaccgagctgggtcccctgaaggaggaggagaagctgatgaaagagggcagcgagaaggagaaaccccagcccctggagcccacatctgctctgagcaatgggtgcgccctcgccaaccacgccccggccctgccatgcatcaacccactcagcgccctgcagtccgtcctgaacaatcacttgggcaaagccacggagcccttgcgctcaccttcctgctccagcccaagttcaagcacaatttccatgttccacaagtcgaatctcaatgtcatggacaagccggtcttgagtcctgcctccacaaggtcagccagcgtgtccaggcgctacctgtttgagaacagcgatcagcccattgacctgaccaagtccaaaagcaagaaagccgagtcctcgcaagcacaatcttgtatgtccccacctcagaagcacgctctgtctgacatcgccgacatggtcaaagtcctccccaaagccaccaccccaaagccagcctcctcctccagggtcccccccatgaagctggaaatggatgtcaggcgctttgaggatgtctccagtgaagtctcaactttgcataaaagaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaa

SEQ ID NO: 189932 - DNA, 12187 bp, Homo sapiens
  Payload ID: 17504
  Gene Symbol: TSHZ2
  Gene Name: teashirt zinc finger homeobox 2
  Uniprot ID: Q9NRE2
  ENST ID: ENST00000371497
  CDS Start-End: 888-3992
gtgtgtgtgtgcgagggtgtgtgtgtgtgtttgtgtgtgtgtgcatatgtggggggtgtgagtgtgtgtgtgcgaggaagcgggggtgcgtgcgcgtgtgagtgcgtgtgtgagtgtctgtgtgtgtgtctgtgtgtgtgtgtgagtgagtgaattccagattttctgtctttccaaaacccgctcctgtcctctcgcatatcactcacagacggggatctgacagcagccacaaacctacagtgagtgatcgctctccccccggcacgaatccgccatagagatcggcgaggaggaggaggaggaggaggaagaaaagaaggaggaggtggaggaggaggtggaggaggaggaggaggagggaaagaggagaaggaagaagaagaaaaagaagaaacccactaccttcccaggattgccttttttttttccttatctttacgcgcgagtgtgcctgtggcgcgtgtgcgcccctcgtcccttccatccgaacccgggcttggatgtttaataaagaaatcaagtgtctcaacagtcaccaaaaaaaaaaaaaaccgcaaaaacaaaaccaaaaaaattccaaaagcaaaaacaaaaaagagagaggaaaaaaaattcaaaataaacaaacaaacaaacaaggcagaaccaacctctacttcaaagcagccggcacaagccacccgtgtctgccacccagagaggggggtctctggcccgtggtggaggagttgcaggggggatcgtcagggggacagaggccgagtgacgtcctaggagccaccgggcaagaggcggaggagacccagagaggccagagagacagcgggccccagcgcgcggctcggggctggggcgccagaagtgggactggagcgaagtagaggatgccgaggagaaaacagcaggcacccaagcgggcggcaggctacgcccaggaggaacagctgaaagaagaggaggaaataaaagaagaggaggaggaggaggacagcggttcagtagctcaactgcagggtggcaatgacacagggacggacgaggagctagaaacgggcccagagcaaaaaggctgcttcagctaccagaactctccaggaagtcatttgtccaatcaggatgccgagaacgagtctctgctgagtgacgccagtgatcaggtgtcggacatcaagagtgtctgcggcagagatgcctcagacaagaaagcacacactcacgtcaggcttccaaacgaagcacacaattgcatggataaaatgaccgctgtctacgccaacatcctgtcggattcctactggtcaggcctgggccttggcttcaagctgtccaatagtgagaggaggaactgtgacacccgaaacggcagcaacaagagtgattttgattggcaccaagacgctctgtccaaaagcctgcagcagaacttgccttctcggtccgtctcgaaacccagcctgttcagctcggtgcagttgtaccgacagagcagcaagatgtgcgggactgtgttcacaggggccagcagattccgatgccgacagtgcagcgcggcctatgacaccctagtcgagctgactgtgcacatgaatgaaacgggccactatcaagatgacaaccgcaaaaaggacaagctcagacccacgagctattcaaagcccaggaaaagggctttccaggatatggacaaagaggatgctcaaaaggttctgaaatgtatgttttgtggcgactcctttgattccctccaagatttgagcgtccacatgattaaaacaaaacattaccaaaaagtgcctttgaaggagccagtcccaaccatttcctcgaaaatggtcaccccggctaagaaacgcgtttttgatgtcaatcggccgtgttcccccgattcaaccacaggatcttttgcagattctttttcttctcagaagaacgccaacttgcagttgtcctccaacaaccgctatggctaccaaaatggagccagctacacctggcagtttgaggcctgcaagtcccagatcttaaagtgcatggagtgtgggagctcccatgacaccttgcagcagctcaccacccacatgatggtcacaggtcactttctcaaggtcaccagctctgcctccaagaaagggaagcagctggtattagacccgttagcagtggagaaaatgcagtcgttgtctgaggccccaaacagtgattctctggctcccaagccatccagtaactcagcatcagattgtacagcctctacaactgagttaaagaaagagagtaaaaaagaaaggccagaggaaaccagcaaggatgagaaagtcgtgaaaagcgaggactatgaagatcctctacaaaaacctttagaccctacaatcaaatatcaatacctaagggaggaagacttggaagatggctcaaagggtggaggggacattttgaaatctttggaaaatactgtcaccacagccatcaacaaagcccaaaacggggcccccagctggagtgcctaccccagcatccacgcagcctaccagctgtctgagggcaccaagccgcctttgcctatgggatcccaggtactgcagatccggcctaatctcaccaacaagctgaggcccattgcaccaaagtggaaagtgatgccactggtttctatgcccacacacctggccccttacactcaagtcaagaaagagtcagaagacaaagatgaagcggtgaaggagtgtgggaaagaaagtccccacgaagaggcctcatctttcagccacagtgagggcgattctttccgcaaaagtgaaacacctccagaagccaaaaagaccgagctgggtcccctgaaggaggaggagaagctgatgaaagagggcagcgagaaggagaaaccccagcccctggagcccacatctgctctgagcaatgggtgcgccctcgccaaccacgccccggccctgccatgcatcaacccactcagcgccctgcagtccgtcctgaacaatcacttgggcaaagccacggagcccttgcgctcaccttcctgctccagcccaagttcaagcacaatttccatgttccacaagtcgaatctcaatgtcatggacaagccggtcttgagtcctgcctccacaaggtcagccagcgtgtccaggcgctacctgtttgagaacagcgatcagcccattgacctgaccaagtccaaaagcaagaaagccgagtcctcgcaagcacaatcttgtatgtccccacctcagaagcacgctctgtctgacatcgccgacatggtcaaagtcctccccaaagccaccaccccaaagccagcctcctcctccagggtcccccccatgaagctggaaatggatgtcaggcgctttgaggatgtctccagtgaagtctcaactttgcataaaagaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaatagctctgcaggacgaatgccttagtttccactttccagcctggatcccctcacactgaacccttcttcgttgcaccatcctgcttctgacattgaactcattgaactcctcctgacaccctggctctgagaagactgccaaaaaaaaaaaaaaaaaaaaatcaccccagccatttctcttcatcctcactaacaatttggtaatgaagtattgatttccacttctctgcttatgggcggtattagattttcattgataaattgcaatggggctgtctcgtctccacagtacccttttcactgtcacaagaaaacaaagtgccaccgaagaaaagtaatgactgagagcattgatgtacttattttgtcagtttgtaacaggaaagtgggggggagtctaagtcttcatagtctaatgtccaagtgggttgcactagatgtagacacttggaggcttacttttcatggtaatgtccatttcctatttataacccctctgggaacgtttgtctaaaggaaatgtttctgttcagtgtaacaattacagttgcacctggattgcccagtcctgcccctgcactaggggaccattaatcactgcaaagtagaagaattattaagttaaaccagagtttgagccaagaaaacccctgaacaatgttcatcttctgtgaaacttgctcaaatagttaagcttaaccatgttgctgccaaagacttttcctatgcagtggtggggcaccttgatcatcatcattatcttgattggctgaaaaaaaaatagttttaagcacacaccactgtctatgagaactgcaaattgggagaataggtgaaatgcagaatctgagagaacgcgagaagatgagatcattacagggtggaaagttctgcagcagccttttctggtaatccctttctgcagaacctgatgtttatgggctctaaaacgcagcttagctttagaagcaacagaaagcatgaaatagggtgtccattttaaatgtgttcctgcaacttttttcattaaaactttgagggcccaattttaatttgtggaatattcccgttaataatgagatctaattaagacatccattaaaagcccgttaaagttaatttaacgtaaaaattccaatagaactgtattagattttctccattaaattaacgttatggatttttaacggatgtcttaattatacgttattattaacgggaatactgtattacacagattaaaatcaggtcctaagtcaacttggaagagctaagagcatgttttaatattaaaagtcttgcatacctagtgcacagtttggagacgcaaggatagatctgtttactctagttgaacattttctatacaattgaaagcaacctataatagataaatccatcattgcatttaaacaatgaatttccttattctcaaaggacaaatacgtctggattatgtggtaaattgctactcagctatggtgaaatatttatactattctaggcacaacactaggaactaggtgattctgaaacaaaaggaatattttctgttgttgctttaattaccaaggttatttttttttaatctcaacactgacaaaatgaaaccaaatatctcttcctcaccatttctcaaggaggctgcctgttggaattgttttggaaattttgacatgatccctaaattcaacattgggattaaaaaaaaaaaaaaacttcttatttacctcctagggaaagtgttgcccttatgccacatataatagcaaattgctttttttatggcatgcataacctagatgggaaaaaatatggcgcttcggggaaggagggaaaaagtaaatgaagttccaggaatgtcattctgaagtaatgaggcatggacagaaaatatacccctcacatcatcggattgagatggcagtcgaaatagcttcattgaagtgtcagcactcatccatcaatcaatcacccacaaggaaaaatagcaacagtacaacggggtggcttttatgggatttactcatgggcatagggaatagcggctcaaatgtagttctgacatgaaaagcaaggtgctgatattattttttatgatgggaggatcataaagtgaattgagaacagtgaggtctgtctttgcttaacctattcaaccagaaatgaatggagctcgactggaaaggaacagtcttcagatgggttaagattgaagggtggactggactctactgagcaccgtccttcaacaaggaaattctattaaaggaaaatcaatgcattagtattggggttctcgtagctgttaaaaattgtctgctccaatccagggttattaggccaaagttacataattcagatctcactgcaaccatccaaaagtggattctcgagcccttgctccaatggggggaggagatcaatacaattcccaattccatggaaattgtttcccttctaaggaagaaaaaataaatcatctgcttcaacatataatcgatatggttttgttagcgtaatttctatggtgggtggggtgggaggtgagagaaaaaaatattgataaatttggtaagacaggtgaattgccgcctggcaaccgtgcatgtcactgccgagggatggctgctaaggttcaccttagaaaacaagatctgggctggcactggggcatacatcaccactcagcatattcctagaggccaggcctgtcttcactcagccagccctctgaggcttctagaaacttctttctggaggaaaaaaactaaataacataaactcaggagaatgtctttacccaccttcataccactgctttctttttgctgaataaaacacagttctgataagtaagaactttagaattggaaaggaggctgacatgcaaatataatgcaaattaccctcaagtatcgccattcttccaccacctcttggtaccagtgagagcgagagattgccttttcttccccatccctccttccagctaagaccaccaaccagctgcaaattgagatgtccatttaaaaatttatatgtcaatatttaaatgttacatatttggccctattttgtagttcagcaaatcctccaaatacacagcatgttacaaggcactggtggcacagggcacaacaggaaatgatatttatttagcaaattcatttaacaaatattattgggcacctgttatgtgagacactgtcctaggcactgtgggataacaacagcaaacacttcacacaacagcctggccttcctgtgttttacaacagctcctaaagatagctgatatcaagacatttgagggacacagttcatgtagaatcaaaatattagtatttcagaataaggattttttttctgaaaagcatacagagaggaaacagcttaaaaataggtcaagacctaaaaacagaatataatcacggaataaactggataacccagacagtccccacagaatttctttcaggtcacagatttcttaaaactcacccccaaaatgtgcctgcttggttgtttgaatcttgcataattaatgtcacaggcgcaagccgctgaacttagttgagatgcagaaaacaaacaaatgcaatgacatatctgagaagcatttatgtaactccggttaagtggtgaggaggggtgtgtgaagacagtgtgcatgcatgagtgtgtattcatatatatgtgtatacatatgaatttcactgttattttccagggtctatggacaatgtggcagtaagagtctatgatgttctgaaacttttcacagtaaatccaaagattacagaccttacaaggtgcttgcattctgttgcttttccatctgtcacttctcaggttatttgactgtgttcaaaccttcttttctttttcattgagtttcattttttaagcttgttaaatgcttttgtttaaaaaaaaaaaaaaaaccccaaatgtcatttttcacattatcctctcttctctgcaacaaggatagtaagatgtagatgaatgcaaaaataataacaacaataaggaaatatattaaagctttaaaatatgcacatatgtagttctaaagagcaataacggtagtatctatttcgaacatgcattaggcaaaaaagaaatcaaaactgaaattttcgtgtatttttccccttgtaagatgttcaaatgctaacttcattttctcctttcctctatgtggcactttctcaaaatatctatgaaatacttttagacaaagattgagctggagaaagagatacaaatttccatccccccagacagagagacatatttccattgtaggaaggcattaaacattttgaaacttgtgaatcatctttagaatttctactggggaattttacttcttcatccaaagtaaaagccacttatctcctttggttcccagtgacagattcagaggcatacgcagatatacaattttcaggctctagttaatcttcttccaatagttacgaacaatgggctaacaggcgtgggtgtttctccaaaaattattcatgcacaaggcagcccaaagcttcagggaaaactagaaatgtgttatggattagaataggactgttttaaaatgctagtaccaggtggaacgctatttctgcaacaggactctgtccatttcctttggaacaatatattccaagtaaaatggctcttccaaggaatgacacctttacttgacacccttcggcatacaaatgattttaccaatagccatgattattattaaggccttttaaaatacaggctgtttgaaaaaagacagattaaatattcacagcctttgtatcatggttatttgcttaaaacagcttttagaagtacaagtaataactttttgataagaaaccccaggagaaactttttggtaagaaacctcaaaaaatttgaacaaaggcattacaaaaaaaaaaaaaaaactaaccactccattcaactctctcagaaaataaatttcaatgtgttcaatgaattgtcttgaacctgaaacctgcatttagatatcagtcccctgccaatagctaatattaacagaatttgaacaatcatacaattatgtctcaaatgtgaagactttgtacagtaatattttcactttctaaatgacccatataacattcaggaattatagatgtgtatgtatattttttaagtacagaaagttcagccagtcttcagagaagtaaaagtgatgtctattgtgcattgaagtaaatattacaaacattccagtttcgcaatacaatacttgagctttcgaacacctcagacactagaatgtgtaatgcgagtcaaaaaagctgacatacaaaacaattcccatttggctcagggttcctaaatgtcacaatatcttgggtaaaatatactttttgatttcctgatgatgtccttctaatcccttctgactttgattcctaacagccaggcactgttgacatgaatcattaacttccaaacccctttaaaatcaagaagctaggtgatcatacagtcatttcaatggccaaccagttcttgctctacagagcttttacacctttttgggaaacctgatatcaaacacatttatgttatatatttgctcccttgcattaattctagatttttttttaatttcttttagaaagggcaggggggaagtgggtcagagcaaggttcaagaatcacattcatccttgctctaaagtgtttacttgccagcaaagaaaggcaaacacatttttatattcagaaagcagaccggtcattttcaaagaaaaatgactgcaaccatgcctgtagaatgtttctgtgcaagcgcactaattttctatcacctgcatgctgtatataatacatttgcctgtatactaggaagaaaaaccaggctgttttccctgagtacaatgcagcttggatggctgggagcgtaagccttccgtgcatttttatagtgtacatatttgtatatactaactatatcgccatgtatgaacacagattttgttatatttgcttgtttctgtttcctaccaaactggcccacaatggggattcttttgtatagaaaaaatatgcttgtaattttttcctggtcattctctttcaatagcttatgaaagaattagatctgagtttacaaagaaactataagaaccaagtttgtctgtctgcatgagtcccgtccaattgctggatctagggaggaaccaacttcctaattcagagttttccttttaaaggcatgctttacccccatgggaaaactgcacactcatccatgtagaattattctctttgtattttatctaatagtgcctgaaaatttttttaatgtcttcttagaagaagaattcataattgtcaaaatttgaaacattagcttaattttgtttttatgacctcaagattcttctccttatttattcggttgctgttgtaatggggccccaggccattcctgacatcggcgtgttcttcttctgcattaaggatgtttttgaaattacagagattattgagccaacaggctgttttaatcaaaaccatgtttcacttctttttgatgattataaattgtccttgcaatgaaaaaaaaaaaagaacttttctgctaggaagattataccaccctgtggccaaacagattcatcacagataggcatctatgcccatttctctgggatctggaaaattcttcccttggctgaccccaatttcttttactccccattatcctgaatattagctttcaatgcagtcactatttgacatttccaaaggctttgccgcattgtcactgcccaaagacaaacaaccactggaaatgatggctttcctgcttgaaacgaagggggccaggtgcagtggctcaagcctgtaacccctgcactttggaaggctgaggcaggcggatcacttgaggtcaggagtttcagaccaacctggccaacatggcaaaacctcgtctctactaaaaatacaaaaaacattagcagggcatggtggtgcgtgcctgtagtcccagctacttgggaggctgaggcaagagaattgcttgagcccgggaggcgaaggttgcagtgagctgagatggtgccactgcactccagcctgggcaacagagcaagactgtgtctcaaaaaaaaaaaaaagaatggattttcagaaaaagtgctccctttcctgtcctgtggtgccaccatcctgtcctccttcgtaatcatgaacaatctgatcttgaactcccacataacttaaatcaggcaaaaagaaacattcacagcgtccccttgctgaataaaaatgactttgtttggaggcacttaagatgtatgcctgtgtgtggtgccgcagcattgaaattatctgtagaaggggaattttttttaaaaatacaattttatcactagaaataaattccgatggtggaaacgaagaaaacccttaaattatatcacaaaagccattattttttgcatccaaagagtttttttttttaaggaaaatcattctactttgagaactgtaattaaagccctaaataacagacactactttgttgagctattgtgaaaaaaaaacaacacattcgccaaggttatatggagcccctgatttccatcaaaaaggtttctataagtatattatttacatttttatacatgataactcttgcctttgtgttgaaaaaaaaaaagtctcttttttttcccccactcagcagttattggaaatagactgttcccatctgaaaccgtatcgtaatttgcatcaggaaacccaactgctgacattgaggacctgggtgtgttcaattatgattttgctggaggctgtccctcattttaatgctgcagctattgaaccaccttcctgaaacctagctgatacggaatagcagagacatgcctctcaacaccattagctttgcaaatggcttcatttcagtcaacgtcgacttctgctttggccaattgaaaaatgaaaattaaaggagagaagaaaaaaaacacagatgcacttaaaacatgaaaagaattatttatatgataaaaatatatttagcttttcaaagcacaagactgaatagaagtgctctttttatgctttctggagatgttactgttaaatgtctttctacatcaggcttaataaatctgtaatgacatttgatggattga

SEQ ID NO: 189933 - DNA, 980 bp, Homo sapiens
  Payload ID: 17504
  Gene Symbol: TSHZ2
  Gene Name: teashirt zinc finger homeobox 2
  ENST ID: ENST00000605656
  CDS Start-End: 1-585
agaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaatagctctgcaggacgaatgccttagtttccactttccagcctggatcccctcacactgaacccttcttcgttgcaccatcctgcttctgacattgaactcattgaactcctcctgacaccctggctctgagaagactgccaaaaaaaaaaaaaaaaaaaaatcaccccagccatttctcttcatcctcactaacaatttgggtctatggacaatgtggcagtaagagtctatgatgttctgaaacttttcacagtaaatccaaagattacagaccttacaaggtgcttgcattctgttgcttttccatctgtcacttctcaggttatttgactgtgttcaaaccttcttttctttttcattgagtttcattttttaagcttgttaaatgcttttgttt

SEQ ID NO: 189934 - DNA, 3803 bp, Homo sapiens
  Payload ID: 17504
  Gene Symbol: TSHZ2
  Gene Name: teashirt zinc finger homeobox 2
  Uniprot ID: Q9NRE2
  ENST ID: ENST00000603338
  CDS Start-End: 364-3459
atttatttttctagaacacacccgacatgtaggctctattgcaatacatctgaaaacacaaaatctgtttgctccaaaattggtgatagcctctgacttaagatgatggtggccaggcgaggtggttcaagcctgtgattccagcactttgggaggccgaggcaggcagatcagatcatgaggtcaggagttcaagaccagcctggccaacatggtgaaacctcaggaggctgaggcaggagaattccttgaactgggacccaggaggcagaggttgcagtgagctgagatcacgccactgcactccagctggggatacagagcaagactccatctcaaaaaaagaaaaaaaagaaagaaaagatgatggctgctgcgttgctccattatacaggctacgcccaggaggaacagctgaaagaagaggaggaaataaaagaagaggaggaggaggaggacagcggttcagtagctcaactgcagggtggcaatgacacagggacggacgaggagctagaaacgggcccagagcaaaaaggctgcttcagctaccagaactctccaggaagtcatttgtccaatcaggatgccgagaacgagtctctgctgagtgacgccagtgatcaggtgtcggacatcaagagtgtctgcggcagagatgcctcagacaagaaagcacacactcacgtcaggcttccaaacgaagcacacaattgcatggataaaatgaccgctgtctacgccaacatcctgtcggattcctactggtcaggcctgggccttggcttcaagctgtccaatagtgagaggaggaactgtgacacccgaaacggcagcaacaagagtgattttgattggcaccaagacgctctgtccaaaagcctgcagcagaacttgccttctcggtccgtctcgaaacccagcctgttcagctcggtgcagttgtaccgacagagcagcaagatgtgcgggactgtgttcacaggggccagcagattccgatgccgacagtgcagcgcggcctatgacaccctagtcgagctgactgtgcacatgaatgaaacgggccactatcaagatgacaaccgcaaaaaggacaagctcagacccacgagctattcaaagcccaggaaaagggctttccaggatatggacaaagaggatgctcaaaaggttctgaaatgtatgttttgtggcgactcctttgattccctccaagatttgagcgtccacatgattaaaacaaaacattaccaaaaagtgcctttgaaggagccagtcccaaccatttcctcgaaaatggtcaccccggctaagaaacgcgtttttgatgtcaatcggccgtgttcccccgattcaaccacaggatcttttgcagattctttttcttctcagaagaacgccaacttgcagttgtcctccaacaaccgctatggctaccaaaatggagccagctacacctggcagtttgaggcctgcaagtcccagatcttaaagtgcatggagtgtgggagctcccatgacaccttgcagcagctcaccacccacatgatggtcacaggtcactttctcaaggtcaccagctctgcctccaagaaagggaagcagctggtattagacccgttagcagtggagaaaatgcagtcgttgtctgaggccccaaacagtgattctctggctcccaagccatccagtaactcagcatcagattgtacagcctctacaactgagttaaagaaagagagtaaaaaagaaaggccagaggaaaccagcaaggatgagaaagtcgtgaaaagcgaggactatgaagatcctctacaaaaacctttagaccctacaatcaaatatcaatacctaagggaggaagacttggaagatggctcaaagggtggaggggacattttgaaatctttggaaaatactgtcaccacagccatcaacaaagcccaaaacggggcccccagctggagtgcctaccccagcatccacgcagcctaccagctgtctgagggcaccaagccgcctttgcctatgggatcccaggtactgcagatccggcctaatctcaccaacaagctgaggcccattgcaccaaagtggaaagtgatgccactggtttctatgcccacacacctggccccttacactcaagtcaagaaagagtcagaagacaaagatgaagcggtgaaggagtgtgggaaagaaagtccccacgaagaggcctcatctttcagccacagtgagggcgattctttccgcaaaagtgaaacacctccagaagccaaaaagaccgagctgggtcccctgaaggaggaggagaagctgatgaaagagggcagcgagaaggagaaaccccagcccctggagcccacatctgctctgagcaatgggtgcgccctcgccaaccacgccccggccctgccatgcatcaacccactcagcgccctgcagtccgtcctgaacaatcacttgggcaaagccacggagcccttgcgctcaccttcctgctccagcccaagttcaagcacaatttccatgttccacaagtcgaatctcaatgtcatggacaagccggtcttgagtcctgcctccacaaggtcagccagcgtgtccaggcgctacctgtttgagaacagcgatcagcccattgacctgaccaagtccaaaagcaagaaagccgagtcctcgcaagcacaatcttgtatgtccccacctcagaagcacgctctgtctgacatcgccgacatggtcaaagtcctccccaaagccaccaccccaaagccagcctcctcctccagggtcccccccatgaagctggaaatggatgtcaggcgctttgaggatgtctccagtgaagtctcaactttgcataaaagaaaaggccggcagtccaactggaatcctcagcatcttctgattctacaagcccagtttgcctcgagcctcttccagacatcagagggcaaatacctgctgtctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgtaagttgtgctgtcggacatttgtgagcaaacatgcggtaaaactccacctaagcaaaacgcacagcaagtcacccgaacaccattcacagtttgtaacagacgtggatgaagaatagctctgcaggacgaatgccttagtttccactttccagcctggatcccctcacactgaacccttcttcgttgcaccatcctgcttctgacattgaactcattgaactcctcctgacaccctggctctgagaagactgccaaaaaaaaaaaaaaaaaaaaatcaccccagccatttctcttcatcctcactaacaatttggtaatgaagtattgatttccacttctctgcttatgggcggtattagattttcattgataaattgcaatggggctgtctcgtctccacagtacccttttcactgtcacaagaaaacaaagtgccaccgaagaaaagtaatgactgaga

SEQ ID NO: 189935 - DNA, 670 bp, Homo sapiens
  Payload ID: 17504
  Gene Symbol: TSHZ2
  Gene Name: teashirt zinc finger homeobox 2
  ENST ID: ENST00000626626
  CDS Start-End: 23-247
cggggaaggagggaaaaagtaaatgaagttccaggaatgtcattctgaagtaatgaggcatggacagaaaatatacccctcacatcatcggattgagatggcagtcgaaatagcttcattgaagtgtcagcactcatccatcaatcaatcacccacaaggaaaaatagcaacagtacaacggggtggcttttatgggatttactcatgggcatagggaatagcggctcaaatgtagttctgacatgaaaagcaaggtgctgatattattttttatgatgggaggatcataaagtgaattgagaacagtgaggtctgtctttgcttaacctattcaaccagaaatgaatggagctcgactggaaaggaacagtcttcagatgggttaagattgaagggtggactggactctactgagcaccgtccttcaacaaggaaattctattaaaggaaaatcaatgcattagtattggggttctcgtagctgttaaaaattgtctgctccaatccagggttattaggccaaagttacataattcagatctcactgcaaccatccaaaagtggattctcgagcccttgctccaatggggggaggagatcaatacaattcccaattccatggaaattgtttcccttctaaggaagaaaaaataaatcatctgcttcaac

SEQ ID NO: 189936 - DNA, 5176 bp, Homo sapiens
  Payload ID: 17505
  Gene Symbol: TSHZ3
  Gene Name: teashirt zinc finger homeobox 3
  Uniprot ID: Q63HK5
  ENST ID: ENST00000240587
  CDS Start-End: 329-3574
cttcccattccgccggcagcgcggtcctcctcctcctcctccacctcctcctcctctgcctcctcctcccccccgtgctcctccctccccgagcctccctcgcccgccctccttcttccctccgcacgttcggggttcgcggcggagcgcggcgcgggggggacgcggagagcctgggcgcagcagcatcctgcgggcggccgctctccgggggggaggctgagagcaggcccgcctcgcccccccgcgggcccgccgccccctccctccctgtcctcagcccggcagcggcggcggcggcggcagtggcagtcgccggagaagcatcatgccgaggaggaagcagcaggcgccccggcgcgcagcagcctatgtttccgaagagttaaaggctgctgccctggtggacgaaggtttagacccagaggagcatacggcagatggagagccctcggccaagtacatgtgcccggagaaggagctcgccagggcctgccccagctaccagaactccccggccgccgagttttcctgccatgaaatggacagcgagtcacacatcagtgagaccagtgaccgaatggctgactttgaaagcggctccatcaagaacgaagaggagaccaaggaggtcacggtcccactggaagacacgactgtgtcggatagcctggagcagatgaaggccgtgtacaacaacttcctctccaactcctactggtccaacctcaacctcaacctgcaccagccctcctcggagaagaacaacggcagcagcagcagcagcagtagcagcagcagcagctgtggcagcgggagcttcgactggcaccagagcgccatggctaagacgctgcagcaggtgtcacagagccgcatgctcccggagcccagcctcttcagcaccgtgcagctgtaccggcagagcagcaagctctatggctccatcttcacgggggccagcaagttccgctgtaaggactgcagcgctgcctacgacaccctggtggagttgacggtgcacatgaacgagacggggcattaccgcgacgacaaccatgagaccgataacaacaaccccaagcgctggtccaagcctcgcaaacgctccttgctggaaatggaagggaaggaagacgcccagaaggtgctgaagtgcatgtactgtggccactcctttgagtccctgcaggatttgagtgtccatatgatcaaaacaaaacactaccaaaaagtgcctctgaaggaacccgtcactcctgtcgccgccaaaatcatccctgccactcggaagaaagcttccctggagctggagctccccagctccccagattccacaggtggaacccccaaagccaccatctcagacaccaacgatgcacttcagaagaactccaacccttacatcacgccaaataatcggtacggccaccagaatggggccagctatgcatggcactttgaggcccggaagtcgcagatcctgaagtgcatggagtgtgggagctcgcatgacaccctgcaggagctcactgcccacatgatggtcactggccacttcatcaaggtcaccaactctgctatgaaaaaggggaagcccattgtggagacgcctgtcacacctaccatcacaaccctgctggatgagaaggtccagtccgtgcccctggcagccaccaccttcacgtccccctccaatacacctgccagcatctccccaaaactgaatgtggaggtcaagaaggaagtcgacaaggagaaagcggtcactgacgagaaacctaagcaaaaagacaagcctggcgaagaagaggagaagtgtgacatctcttccaaataccattacttgactgaaaatgacttagaagagagtcccaagggggggcttgatatcctcaaatccttggaaaacacagtgacatccgcaatcaacaaggcccagaacggcactcctagctgggggggctatcccagcatccatgccgcctaccaacttcccaacatgatgaagttgtccctgggctcgtcggggaagagcacgcccctgaaacccatgtttggcaacagtgagattgtctccccgacgaaaaaccagaccctggtctctccacccagcagccagacgtcccccatgcccaagacaaactttcatgccatggaggagctggtgaaaaaggtcactgagaaagttgccaaagtggaggagaagatgaaggagccggatgggaagctttccccgcccaagcgggccactccctccccatgtagcagcgaagtcggggaacccatcaagatggaggcatccagcgatgggggcttccgcagccaggagaacagccccagccccccgcgggatgggtgcaaggatgggagccccctcgctgagccggtggagaatggcaaggagctggtgaagcccctagccagcagtttgagtggcagcacggccatcatcaccgaccacccgcctgaacagccttttgttaaccctttgagcgccctgcagtcagtcatgaacattcacctgggcaaggccgccaagccctccctgcctgccctggaccccatgagcatgcttttcaagatgagcaacagcctggcggagaaggctgctgtggccaccccgccgcccctgcagtccaagaaggcagaccacctcgaccgctatttctaccacgtcaacaacgaccagcccatagacttgacaaaagggaagagtgacaaaggctgctccttgggttcagtgcttctgtcacccacgtccacagccccggcaacctcctcatccacggtgacaacggcaaagacatctgccgtcgtatcattcatgtcaaactcgccgctacgcgagaatgccttgtcagatatatccgatatgctgaagaacttgacagagagccacacgtcaaaatcctccactccttccagcatctccgagaagtctgacattgacggggccactctggaggaggctgaggagtcgacgcccgcccagaagaggaagggccgccagtcaaactggaacccccagcacctcctgatcctccaggcccagtttgccgccagcctccggcagacctcagaagggaagtacatcatgtcagacctgagcccccaggagcggatgcatatctccaggttcaccgggctgtccatgaccaccatcagccactggctggccaacgtgaaataccagcttcgaaggacaggtggaacaaagttcctcaaaaacttggacactggccaccccgtcttcttttgtaacgattgtgcgtcccaaatcaggactccttccacgtacatcagtcacctagagtcacacttaggcttccggctacgggacttatccaaactgtccaccgaacagattaacagtcagatagcacaaaccaagtcaccgtcagaaaaaatggtgacgtcctcccccgaggaagacctggggacttcctatcagtgcaaactttgcaatcggacctttgccagcaagcacgctgttaaacttcaccttagcaaaacacacgggaaatctccggaagaccaccttctgtatgtctctgagttagagaagcagtagcatttgcttttgatagaaaggactgcagtttgctttgagggaaactgtggaaggcaccttcaggccccctctgacttgttgttcttggcacatgttcttattttaactgcagagaatcactctgggctggactgttttgtataactgtacagtgtttaatagaggtgcataatcagctgttgttactggtaaaatatgaaggttaaaatgcagtggtaagtgtttggaactttgtgtaaacgggatttagttgtgagcatcctcccgatgcttcaagctgcatgcattaacagacagtttaattaagcatttataacggaatcaggcacaccttttccacgagactcgagtgtgctggcatttctcaccctttcatctttagccctctgagtactttgaagcacttttgcattaatttggttaaaaaataaaataaaataataataatgtatgaagctctgttttttaaactccttaccagcttagttataatgaataatatgaacctccatttatgcaggtctgcaggggtataacacgccttgaaatttaaaagaatattattttcacattgaaacatagatgtatatattgtatagatttcagactctcttatgaaaaaaaatgtgattgtggttaaatgacctttttcttgcatttatagcaacagtgttttatgcacctgctatgctctgggcataagctgtgcctatgtatagtgtatatttctttttttcttttttttaaggtctatgggttttgttttttacatgcaaacattgtaaattatacagaagataccacagatagcatttataaagtatacagaaacattatctgaaagcaaagtatgatagtttgttttgctatacagtacatctatattgatagaggttcatgtttaaattatacatatttattagcatcatattgtcatttgttttgagcagtctgaataaacgagaccgggaaagacatccctggcaggcatcagaactattttgcacatgatttttaaaggtatttattagaaatcaaagaacactcaaaataaactcagtgctcaaagggttaagtctatttgaaaaggttaaaaaaaagaacaaaaaaaaaaaaagaacttgtactgtatttcctaaacattgataaagcctttaaaatgtttgtactgtaatactttgcttaaaagtcatgaggcattctgtgatccaacctctttcacttatttataagccctcttggttgctattccatattgtaggatgcctttctatttcaattggtaactttctgttttgttcttcctaattattctcccaagatcccacactgcagctttatctttaggcttatgaaaggtaacccgtggttaccggctctccaagtgattctgttcttctccatttttggcagttaatttgcagaagtaactgacagctgacaccatatgagaacctttgtataaaatattggcatgtaaacagcacagacaccgtaacacactctgtgccctgtttggttgttgacaatgaagcaccattatgtgactcttcatataacccttttttctacggcagcattaaaattgtctttttgctataa

SEQ ID NO: 189937 - DNA, 441 bp, Homo sapiens
  Payload ID: 17505
  Gene Symbol: TSHZ3
  Gene Name: teashirt zinc finger homeobox 3
  ENST ID: ENST00000558569
  CDS Start-End: 37-138
ggcggcggcggcagtggcagtcgccggagaagcatcatgccgaggaggaagcagcaggcgccccggcgcgcagcagacaagagcatcaattgggtggaggttctcagcacgtggtgggtggagaacgtgctgccctagtctcttcacactacccctgtgtacctgtggagcctaaaacacctgggaaggaagcaaaccccagagctccgaaacctccatttccaaaaaggatcgagagccagtctcctagaaatggagcccttagtggtggtccacgctggagacgatgacaaacaattggacccttgtgtccccaagctgtgggctccctggcgatgacaccggagctgtctctattttgcctgtcgggggaatgttccagcgcattttcccttattatgacttgattaaggacacaataaacccttgccatgattttta

SEQ ID NO: 189938 - DNA, 3687 bp, Homo sapiens
  Payload ID: 17506
  Gene Symbol: TEC
  Gene Name: tec protein tyrosine kinase
  Uniprot ID: P42680
  ENST ID: ENST00000381501
  CDS Start-End: 159-2054
gggcggggcggggcgctttgctctggactctggggcgctaggctccggactccgcggcgcagactgcacctcgcagtctccccaggtccgcccagcagccgcgcttcagccagaatactgggatcttcagtggcaggaggagtaatcagaagacggagatgaattttaacactattttggaggagattcttattaaaaggtcacagcagaaaaagaagacatcgcccttaaactacaaagagagactttttgtacttacaaagtccatgctaacctactatgagggtcgagcagagaagaaatacagaaaggggtttattgatgtttcaaaaatcaagtgtgtggaaatagtgaagaatgatgatggtgtcattccctgtcaaaataagtatccatttcaggttgttcatgatgctaacacactttacatttttgcacctagtccacaaagcagggacctgtgggtgaagaagttaaaagaagaaataaagaacaacaataatattatgattaaatatcatcctaaattctggacagatggaagttatcagtgttgtagacaaactgaaaaattagcacccggatgtgaaaaatacaatctttttgagagcagtataagaaaagcactacctccagcaccagaaacaaagaagcgaaggcctcccccaccaattccactagaagaagaagataatagtgaagaaatcgttgtagccatgtatgatttccaagcagcagaaggacatgatctcagattagagagaggccaagagtatctcattttagaaaagaatgatgttcattggtggagagcaagagataaatatgggaatgaaggatatatcccaagtaattacgtaacgggaaagaaatcaaacaacttagatcaatatgaatggtattgcagaaatatgaatagaagcaaggcagagcaactcctccgcagtgaagataaagaaggtggttttatggtaagggattccagtcaaccaggcttgtacacagtctccctttataccaagtttggaggagaaggttcatcgggttttaggcattatcatataaaggaaacaacaacatctccaaagaagtattacctagctgaaaaacatgcttttggctccattcctgagattattgaatatcataagcacaatgcagcaggacttgtcaccaggcttcggtacccagttagtgtgaaagggaagaatgcacccaccactgcaggattcagctatgagaaatgggagattaacccttcagaactgacctttatgagggaattgggaagtggactgtttggagtggtgaggcttggcaaatggcgagcccagtacaaagtcgcaatcaaagctattcgggaaggtgcaatgtgcgaggaggactttatagaagaagctaaagtgatgatgaaactgacacacccgaagttagtgcagctttatggtgtgtgcacccagcagaaaccaatatacattgttactgagttcatggaaaggggctgccttctgaatttcctccgacagagacaaggtcatttcagtagagacgtactgctgagcatgtgtcaggatgtgtgtgaagggatggagtatctggagagaaacagcttcatccacagagatctggctgccagaaattgtctagtaagtgaggcgggagttgtaaaagtatctgattttggaatggccaggtatgttctggatgatcagtacacaagttcttctggtgctaagtttcctgtgaagtggtgtccacctgaagtgtttaattacagccgcttcagcagcaaatcagatgtctggtcatttggtgttttaatgtgggaagtattcacggaaggcagaatgccttttgaaaaatacaccaattatgaagtggtaaccatggttactcgaggccaccgactctaccagccgaagttggcgtccaactatgtgtatgaggtgatgctgagatgttggcaggagaaaccagagggaaggccttctttcgaagatctgctgcgcacaatagatgaactagttgaatgtgaagaaacttttggaagataagtgatgtgtgaccagtggctcccagattcccaagcacaaggaaggatgggcattttgtggcttttaatttattgagcacttggacatgtagatcattttacttatacagtggaaacacataaataatttgcttctagaccagcctctgtctagacttgcttctagacagaatctcccagagtgtggaaatgttgccttagaaatggtgattaaaatcactcatttctattcattcctcaggcacttgagtgacagttgtttaccaggcactgtgtgtagccccagggtttggccattcaggggtgcacacatgggaccatgttagctgatgccagttgaaggccagggtatttgggaaggggaagggtattagagtcatgaccaagcaacccttctttttccctttgacttctacagaaatctgggcctgagacattgtctacaattgggttctagatacatcaggaacccatcttggataaataaatacctatcttttgttttgaaaacatctcagttttcaagactgctcttagtattacatgaacaatatttgtatgctgtatatattgtaaatatatataatatataaagttatatatttatgagaaacacgaattgtcttttaattgaaacttttaatcctgtagtataggagttcaccttcttaggactagagactgtgccttatagctgttaattcatttccccctgaacatcaaatatgcctgaagagaagaaagtctagattcttctatgagtaacgccccctcctcactcaggtaaatgtgtctggggatgcctgtccagcttaaccacgtgcatttggcctatgtaatcctgcccatggtggccgcagctaatcagaatcagatggaaaattaaaccgggtaatctacttctaagccttaagaatattccctgggacacagacactataattggaagtgctgagctctggggcagaaggatcaggtgaccttcgcaacaaagtttgcccccacctcacataggacccggaagcagcctgagctgtggcggaggatccaggaagctacggagagaagcagccagcatggtgttccgtgcctcccggacgtttttcaggaggcctggttggacttgggttcctggatggtgggattgttgtacagcctctcaggagaccctgctgtcaagactgtgtgtgtggatttctcacccttagaagctctactaagacatcaacggaattagggccttcctttttgccttgtgagcgccaaggaaaagaaactatctcggtcacgtgagcgccagcgaaaagaaactgtatcagtcatccagagaccgtttattgcccaacacgttattcttgctgttggtggggtaactagccgaggaagacacagcgccttcccttcaggagttgcgtctcctctgcaggccacgatggtctgctctggagcattgggtgaacacacaggctggctgctctgggcagcgccttcactctgaccctggagaaccatttcatttcatcctggtcagtctagagtctgtgcaccaggcagtccatccactgaaggctgtgtttattcttttcctgtgcccctcataatggaagaaagtaaactgcttatcccgagcctta

SEQ ID NO: 189939 - DNA, 681 bp, Homo sapiens
  Payload ID: 17506
  Gene Symbol: TEC
  Gene Name: tec protein tyrosine kinase
  ENST ID: ENST00000515146
  CDS Start-End: 113-268
aggacttgtcaccaggcttcggtacccagttagtgtgaaagggaagaatgcacccaccactgcaggattcagctatgagaaatgggagattaacccttcagaactgacctttatgagggaattgggaagtggactgtttggagtggtgaggcttggcaaatggcgagcccagtacaaagtcgcaatcaaagctattcgggaaggtgcaatgtgcgaggaggactttatagaagaagctaaagtgatgatgctgccagaaattgtctagtaagtgaggcgggagttgtaaaagtatctgattttggaatggccaggtatgttctggatgatcagtacacaagttcttctggtgctaagtttcctgtgaagtggtgtccacctgaagtgtttaattacagccgcttcagcagcaaatcagatgtctggtcatttggtgttttaatgtgggaagtattcacggaaggcagaatgccttttgaaaaatacaccaattatgaagtggtaaccatggttactcgaggccaccgactctaccagccgaagttggcgtccaactatgtgtatgaggtgatgctgagatgttggcaggagaaaccagagggaaggccttctttcgaagatctgctgcgcacaatagatgaactagttgaatgtgaagaaacttttggaagataagtgatg

SEQ ID NO: 189940 - DNA, 2446 bp, Homo sapiens
  Payload ID: 17506
  Gene Symbol: TEC
  Gene Name: tec protein tyrosine kinase
  ENST ID: ENST00000505452
  CDS Start-End: 46-348
aatactgggatcttcagtggcaggaggagtaatcagaagacggagatgaattttaacactattttggaggagattcttattaaaaggtcacagcagaaaaagaagacatcgcccttaaactacaaagagagactttttgtacttacaaagtccatgctaacctactatgagggtcgagcagagaagaaatacagaaaggggtttattgatgtttcaaaaatcaagtgtgtggaaatagtgaagaatgatgatggtgtcattccctgtcaaaataagtatccatttcagtccacaaagcagggacctgtgggtgaagaagttaaaagaagaaataaagaacaacaataatattatgattaaatatcatcctaaattctggacagatggaagttatcagtgttgtagacaaactgaaaaattagcacccggatgtgaaaaatacaatctttttgagagcagtataagaaaagcactacctccagcaccagaaacaaagaagcgaaggcctcccccaccaattccactagaagaagaagataatagtgaagaaatcgttgtagccatgtatgatttccaagcagcagaaggacatgatctcagattagagagaggccaagagtatctcattttagaaaagaatgatgttcattggtggagagcaagagataaatatggatggtattgcagaaatatgaatagaagcaaggcagagcaactcctccgcagtgaagataaagaaggtggttttatggtaagggattccagtcaaccaggcttgtacacagtctccctttataccaagtttggaggagaaggttcatcgggttttaggcattatcatataaaggaaacaacaacatctccaaagaagtattacctagctgaaaaacatgcttttggctccattcctgagattattgaatatcataagcacaatgcagcaggacttgtcaccaggcttcggtacccagttagtgtgaaagggaagaatgcacccaccactgcaggattcagctatgagaaatgggagattaacccttcagaactgacctttatgagggaattgggaagtggactgtttggagtggtgaggcttggcaaatggcgagcccagtacaaagtcgcaatcaaagctattcgggaaggtgcaatgtgcgaggaggactttatagaagaagctaaagtgatgatgaaactgacacacccgaagttagtgcagctttatggtgtgtgcacccagcagaaaccaatatacattgttactgagttcatggaaaggggctgccttctgaatttcctccgacagagacaaggtcatttcagtagagacgtactgctgagcatgtgtcaggatgtgtgtgaagggatggagtatctggagagaaacagcttcatccacagagatctggctgccagaaattgtctagtaagtgaggcgggagttgtaaaagtatctgattttggaatggccaggtatgttctggatgatcagtacacaagttcttctggtgctaagtttcctgtgaagtggtgtccacctgaagtgtttaattacagccgcttcagcagcaaatcagatgtctggtcatttggtgttttaatgtgggaagtattcacggaaggcagaatgccttttgaaaaatacaccaattatgaagtggtaaccatggttactcgaggccaccgactctaccagccgaagttggcgtccaactatgtgtatgaggtgatgctgagatgttggcaggagaaaccagagggaaggccttctttcgaagatctgctgcgcacaatagatgaactagttgaatgtgaagaaacttttggaagataagtgatgtgtgaccagtggctcccagattcccaagcacaaggaaggatgggcattttgtggcttttaatttattgagcacttggacatgtagatcattttacttatacagtggaaacacataaataatttgcttctagaccagcctctgtctagacttgcttctagacagaatctcccagagtgtggaaatgttgccttagaaatggtgattaaaatcactcatttctattcattcctcaggcacttgagtgacagttgtttaccaggcactgtgtgtagccccagggtttggccattcaggggtgcacacatgggaccatgttagctgatgccagttgaaggccagggtatttgggaaggggaagggtattagagtcatgaccaagcaacccttctttttccctttgacttctacagaaatctgggcctgagacattgtctacaattgggttctagatacatcaggaacccatcttggataaataaatacctatcttttgttttgaaaacatctcagttttcaagactgctcttagtattacatgaacaatatttgtatgctgtatatattgtaaatatatataatatataaagttatatatttatgagaaa

SEQ ID NO: 189941 - DNA, 1539 bp, Homo sapiens
  Payload ID: 17507
  Gene Symbol: TCTN1
  Gene Name: tectonic family member 1
  ENST ID: ENST00000377654
  CDS Start-End: 1-1452
atgatcacagctcactgcagcctcgacctcctaggctcagttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataagactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaagcattttgttttgcaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagc

SEQ ID NO: 189942 - DNA, 1879 bp, Homo sapiens
  Payload ID: 17507
  Gene Symbol: TCTN1
  Gene Name: tectonic family member 1
  Uniprot ID: Q2MV58
  ENST ID: ENST00000397655
  CDS Start-End: 71-1792
gcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcaggccaggcgtactggttcacacctgtaatcccagcactctgggaggccgaggcgagaggatcacttgaggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagc

SEQ ID NO: 189943 - DNA, 2098 bp, Homo sapiens
  Payload ID: 17507
  Gene Symbol: TCTN1
  Gene Name: tectonic family member 1
  ENST ID: ENST00000397656
  CDS Start-End: 78-617
atgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactcacattttactccaggactttcacggtggctgtgtgagagtagaagtcggattctttcattcccatagccatccggagagagcttctccttacaggttgatacagcaaactcatcagtccaggggctagagaaatagacggattattattggcttctgttgtgctgtttacttataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaact

SEQ ID NO: 189944 - DNA, 1885 bp, Homo sapiens
  Payload ID: 17507
  Gene Symbol: TCTN1
  Gene Name: tectonic family member 1
  Uniprot ID: Q2MV58
  ENST ID: ENST00000397659
  CDS Start-End: 20-1798
cgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaagcattttgttttgcaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagc

SEQ ID NO: 189945 - DNA, 1996 bp, Homo sapiens
  Payload ID: 17507
  Gene Symbol: TCTN1
  Gene Name: tectonic family member 1
  ENST ID: ENST00000464809
  CDS Start-End: 19-321
gctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacggtgggtaccatgtgccagctcctggagtccacagtgatccaacctcaaggggacagccccgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactgcagatgctctgtgtgatttgtaatctgaagtgataactggccagtgactgtcaggttctctgtcgtaacaccagcccagtgaacatgccagcctgcttccttctctctcttctgtacacagcacattttactccaggactttcacggtggctgtgtgagagtagaagtcggattctttcattcccatagccatccggagagagcttctccttacaggttgatacagcaaactcatcagtccaggggctagagaaatagacggattattattggcttctgttgtgctgtttacttataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaacta

SEQ ID NO: 189946 - DNA, 1874 bp, Homo sapiens
  Payload ID: 17507
  Gene Symbol: TCTN1
  Gene Name: tectonic family member 1
  ENST ID: ENST00000490514
  CDS Start-End: 82-333
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgggtctcactctgtcactcaggctggagtatagtggcatgatcacagctcactgcagcctcgacctcctaggctcagttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataagggtggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaagcattttgttttgcaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaacta

SEQ ID NO: 189947 - DNA, 1988 bp, Homo sapiens
  Payload ID: 17507
  Gene Symbol: TCTN1
  Gene Name: tectonic family member 1
  ENST ID: ENST00000495659
  CDS Start-End: 77-379
tgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacggtgggtaccatgtgccagctcctggagtccacagtgatccaacctcaaggggacagccccgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagc

SEQ ID NO: 189948 - DNA, 1891 bp, Homo sapiens
  Payload ID: 17507
  Gene Symbol: TCTN1
  Gene Name: tectonic family member 1
  ENST ID: ENST00000480648
  CDS Start-End: 16-807
gggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcaggccaggcgtactggttcacacctgtaatcccagcactctgggaggccgaggcgagaggatcacttgagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttg

SEQ ID NO: 189949 - DNA, 370 bp, Homo sapiens
  Payload ID: 17507
  Gene Symbol: TCTN1
  Gene Name: tectonic family member 1
  ENST ID: ENST00000547461
  CDS Start-End: 1-285
gacactgatgtgctgcagccgactctcgtcaacgctggacactttagcctttgcgtgaatgttgttcttgagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactca

SEQ ID NO: 189950 - DNA, 2309 bp, Homo sapiens
  Payload ID: 17507
  Gene Symbol: TCTN1
  Gene Name: tectonic family member 1
  Uniprot ID: Q2MV58
  ENST ID: ENST00000551590
  CDS Start-End: 157-1920
atccgccccctgcctcatccaggcttcgccccagtcagtctccggcagcttctcgcggcttcgcaagccccttcccgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcagcgtttctggtgaaccaggctgttaagtgcaccagaaaaataaatttagaacagtgtgaagaaattgaagccctcagcatggctttttacagcagcccggaaattctgagggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataaggggtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagcaattgtccagctttgttgctcattttcaattaaggctaaagtgttcaacatgagaaaatgtgatacatttgatacagtgtggggtgggagtggatgggcagctcttggtggtactggaccttccacaaggctgtgtccacccagaatccatgctggcaggagggaggcagaggtatcaaaccaaacctctcaccaagcggcccaggaggggcagctgttcctctcgtgacagcacaggcccatgagacagtgtcttctttttgaggggagctggtccgggtctagttcacttcaccaagaag

SEQ ID NO: 189951 - DNA, 458 bp, Homo sapiens
  Payload ID: 17507
  Gene Symbol: TCTN1
  Gene Name: tectonic family member 1
  ENST ID: ENST00000549123
  CDS Start-End: 241-458
atgcaggtgaagtcaccaaagctgatctctcattcgttctggggacagttagcagcgtagtggtcccactgcagcaaaagtttgaaattcattttcttcaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagc

SEQ ID NO: 189952 - DNA, 926 bp, Homo sapiens
  Payload ID: 17507
  Gene Symbol: TCTN1
  Gene Name: tectonic family member 1
  ENST ID: ENST00000546643
  CDS Start-End: 60-326
tcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacggggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgaggtgagcctgaacttgattgattcttttcatcccatcacaaatatctttccttgtaagttaattttcaaggttaccaggaaaactgggttccttgagacagagttgatattatagactaaaaaacttaatgttcatgcctacaaatcaaagatcatgaaaattaaaactgaatatttgaagatggattaaagacttaaatgtaagacctaaaaccatacaaaccctagaagaaaacccaggcaataccattcaggacatagacatgggcaaagacatcatgagtaaaacaaccaaaagcaatggcaacaaaagccaaaattgacaaatgggatctaattaaactaaagagcttctgcacagcaaa

SEQ ID NO: 189953 - DNA, 2149 bp, Homo sapiens
  Payload ID: 17507
  Gene Symbol: TCTN1
  Gene Name: tectonic family member 1
  ENST ID: ENST00000550703
  CDS Start-End: 157-894
atccgccccctgcctcatccaggcttcgccccagtcagtctccggcagcttctcgcggcttcgcaagccccttcccgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgaggtgagcctgaacttgattgattcttttcatcccatcacaaatatctttccttgtaagttaattttcaaggttaccaggaaaactgggttccttgagacagagttgatattatagactaaaaaacttaatgttcatgcctacaaatcaaagatcatgaaaattaaaactgaatatttgaagatggattaaagacttaaatgtaagacctaaaaccatacaaaccctagaagaaaacccaggcaataccattcaggacatagacatgggcaaagacatcatgagtaaaacaaccaaaagcaatggcaacaaaagccaaaattgacaaatgggatctaattaaactaaagagcttctgcacagcaaaagaaactatcatcagagtgaacgtgtgacctacagaatgggaaaaaatttttgcaatctatccatatgacaaagggctaatatccagaatctacaaggaacttaaataaatttacaagaaaaaaacaaccccatcaaaaagtgggtgaaggatatgaatagacacttttcaaaagaagacatttaagtggccaacgaacctatgaaaaaaggctcatcatcactggtcattagagaaatgcaaatcaaaactgcaatcagataccatctcacgccagttagaatgacgattattaagaagtcaggaaacaacaggtgctggagaggatatggagaaataggaacgcttttacactgttgggtgggagtgtaaattatttcaaccattgtggaagacagtgcggcgattcctcaaggatctagaacctaaaataccatttgacccagcaattccattactgagtatatacccaaaggattataaatcattctataaagacacacgcacacgtatgtttattgcagcactattcacaatagcaaagacttggaaccaacccaaatgtccatcagtgatagactgggtgaagaaaatgtggcacatacacaacatggaatgctaagcagccataaaaaaggatgagttcatgtcctttgtaggaaaccatcattctcagcaaactaacatggaacagaaaaccaaacatcgcatgttctcactcataagtgggagttgaacaatgagaacacatggacacagggaggggaacatcacacacaggggcctgtcagagggtggtgggctaggggaggggatagcattaggagaaacacctaatgtagatgatgggttgatgagtgcagtaaaccaccatggcacgtgtatacctacgtaacaaacctgcatgttctgcacccgttatcccagaacttaaaatataataataaaaataaaactgaatatttgaattctgaatagaggatttaaggttgtttattctgtgat

SEQ ID NO: 189954 - DNA, 718 bp, Homo sapiens
  Payload ID: 17507
  Gene Symbol: TCTN1
  Gene Name: tectonic family member 1
  ENST ID: ENST00000471804
  CDS Start-End: 58-546
gcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactgcagatgctctgtgtgatttgtaatctgaagtgataactggccagtgactgtcaggttctctgtcgtaacaccagcccagtgaacatgccagcctgcttccttctctctcttctgtacacagcacattttactccaggactttcacggtggctgtgtgagagtagaagtcggattctttcattcccata

SEQ ID NO: 189955 - DNA, 1919 bp, Homo sapiens
  Payload ID: 17507
  Gene Symbol: TCTN1
  Gene Name: tectonic family member 1
  ENST ID: ENST00000478122
  CDS Start-End: 58-360
gcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacggtgggtaccatgtgccagctcctggagtccacagtgatccaacctcaaggggacagccccgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgaggtgagcctgaacttgattgattcttttcatcccatcacaaatatctttccttgtaagttaattttcaaggttaccaggaaaactgggttccttgagacagagttgatattatagactaaaaaacttaatgttcatgcctacaaatcaaagatcatgaaaattaaaactgaatatttgaagatggattaaagacttaaatgtaagacctaaaaccatacaaaccctagaagaaaacccaggcaataccattcaggacatagacatgggcaaagacatcatgagtaaaacaaccaaaagcaatggcaacaaaagccaaaattgacaaatgggatctaattaaactaaagagcttctgcacagcaaaagaaactatcatcagagtgaacgtgtgacctacagaatgggaaaaaatttttgcaatctatccatatgacaaagggctaatatccagaatctacaaggaacttaaataaatttacaagaaaaaaacaaccccatcaaaaagtgggtgaaggatatgaatagacacttttcaaaagaagacatttaagtggccaacgaacctatgaaaaaaggctcatcatcactggtcattagagaaatgcaaatcaaaactgcaatcagataccatctcacgccagttagaatgacgattattaagaagtcaggaaacaacaggtgctggagaggatatggagaaataggaacgcttttacactgttgggtgggagtgtaaattatttcaaccattgtggaagacagtgcggcgattcctcaaggatctagaacctaaaataccatttgacccagcaattccattactgagtatatacccaaaggattataaatcattctataaagacacacgcacacgtatgtttattgcagcactattcacaatagcaaagacttggaaccaacccaaatgtccatcagtgatagactgggtgaagaaaatgtggcacatacacaacatggaatgctaagcagccataaaaaaggatgagttcatgtcctttgtaggaaaccatcattctcagcaaactaacatggaacagaaaaccaaacatcgcatgttctcactcataagtgggagttgaacaatgagaacacatggacacagggaggggaacatcacacacaggggcctgtcagagggtggtgggctaggggaggg

SEQ ID NO: 189956 - DNA, 589 bp, Homo sapiens
  Payload ID: 17507
  Gene Symbol: TCTN1
  Gene Name: tectonic family member 1
  ENST ID: ENST00000481720
  CDS Start-End: 71-391
gcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacggacacgcaacttgtagatatcggagcaggaggctgactgtgagtggagaactggatggaaaattgcaggtggcttcaggcagtgttggtggagaagagtgataacccttcatcttgaatctgggctctgttcattagtaccctgctctacaagccagttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtag

SEQ ID NO: 189957 - DNA, 593 bp, Homo sapiens
  Payload ID: 17507
  Gene Symbol: TCTN1
  Gene Name: tectonic family member 1
  ENST ID: ENST00000552318
  CDS Start-End: 121-387
agtctccggcagcttctcgcggcttcgcaagccccttcccgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacggggcgacagccagttttgtagtcaaaaagcagtcatctattcattgaattttacagcaaacccacctcaaagagtatttgaacttgttgaccagattaatccatctattttctgcattcatattacaaactaagtacctgatgaaaacaattttgatacattgatgaaaacatctgatggttttacattgaatgctgaatcatatgtttccttcacaaccaaactggatattcctactgctgctaaatatgag

SEQ ID NO: 189958 - DNA, 573 bp, Homo sapiens
  Payload ID: 17507
  Gene Symbol: TCTN1
  Gene Name: tectonic family member 1
  ENST ID: ENST00000498072
  CDS Start-End: 82-309
cgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacggtggataaattatttgcctaattttaggacacgcaacttgtagatatcggagcaggaggctgactgtgagtggagaactggatggaaaattgcaggtggcttcaggcagtgttggtggagaagagtgataacccttcatcttgaatctgggctctgttcattagtaccctgctctacaagccagttgctgttctctgtgtctgtgacttatccccagcacagtgtgacatcaactgctgctgtgatcccgactgcagctccgtggatttcag

SEQ ID NO: 189959 - DNA, 1965 bp, Homo sapiens
  Payload ID: 17507
  Gene Symbol: TCTN1
  Gene Name: tectonic family member 1
  ENST ID: ENST00000614115
  CDS Start-End: 157-1878
atccgccccctgcctcatccaggcttcgccccagtcagtctccggcagcttctcgcggcttcgcaagccccttcccgtgatgccccgcgcctggctgtcgcggttgccgggcaacgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacgggcgacagccagttttgtagtcaaaaagcagtcatctattcattgaattttacagcaaacccacctcaaagagtatttgaacttgttgaccagattaatccatctattttctgcattcatattacaaactataaacctgcattatcctttattaatccagaagtacctgatgaaaacaattttgatacattgatgaaaacatctgatggttttacattgaatgctgaatcatatgtttccttcacaaccaaactggatattcctactgctgctaaatatgagtatggggttcctctgcagacttcagattcgtttctgagatttccttcgtccctgacatcatctctgtgcactgataataaccctgcaggccaggcgtactggttcacacctgtaatcccagcactctgggaggccgaggcgagaggatcacttgaggtacctgattcaagaaaaaaggtccctatcactgttcagtccatcgtcattcagtctctaaataaaacgctcacccgacgggaggacactgatgtgctgcagccgactctcgtcaacgctggacactttagcctttgcgtgaatgttgttcttgaggtaaagtacagcctcacatacacagatgcaggtgaagtcaccaaagctgatctctcattcgttctggggacagttagcagcgtagtggtcccactgcagcaaaagtttgaaattcattttcttcaggaaaatacccagccagtccctctcagtggaaaccctggttatgtcgtggggctcccattagctgctggattccagcctcataagatgtctgggattattcagaccacaaatagatatggacagcttactattcttcatagcacaactgagcaagactgcttagcactggagggggtccggaccccagtattatttggttacactatgcaatctggctgtaaactaagactgactggagctctcccgtgtcagctcgtagcacagaaggtgaagagcctgctgtggggccagggcttcccagattacgtggccccttttggaaattcccaggcccaggacatgctggactgggtgcccatccacttcatcacccagtcattcaacaggaaggattcctgccagctcccaggggctttggttatagaagtgaagtggactaaatacggatccctgctgaatccacaggccaaaatagtcaatgtaactgcaaatctaatttcatcctcctttcctgaggccaactcaggaaatgaaaggacgattcttatttccactgcggttacttttgtggatgtgtctgcacctgcagaggcaggcttcagagctccaccagccatcaatgccaggctgccctttaacttcttcttcccgtttgtttgacaatgctcagatgcatcagttccttaatatacacgtgaaatttgaaaactgtacattcggtgagattaaattttatatacaactagc

SEQ ID NO: 189960 - DNA, 2912 bp, Homo sapiens
  Payload ID: 17508
  Gene Symbol: TCTN2
  Gene Name: tectonic family member 2
  Uniprot ID: Q96GX1
  ENST ID: ENST00000303372
  CDS Start-End: 129-2222
atagctccgggcgttcgcttgcaagatggcggcggcggggcagtggctgctgcgttttcgtgtctgagtccttcctgggttctaatgagggcgcggttctgctgtgcccggcccgcgaggtctaaggcatgggcttccagcctccggccgctcttcttttgaggcttttccttctgcagggcatcctgaggcttctgtggggggacctggctttcatccctccttttatccgaatgtccggccctgcggtcagcgcgtccctggtcggagacaccgagggtgtgaccgtgtccctggcagtgctgcaggacgaggcgggaatattgccaattccgacgtgtggagtgctgaacaatgagacggaagactggagcgtgactgtgatccccggtgcgaaggtgttggaagtgacagtgaggtggaagagaggtctggactggtgttcctccaatgagacagattccttctcagagtccccctgtatcctccagacccttctggtttcagcatctcataattcatcctgttcagcacatctactcattcaagtggaaatttatgccaactcttctctgacccataatgcctcagagaacgtgactgtcattcctaaccaggtgtatcagccccttggcccttgtccttgtaatttaacagctggagcctgtgatgttcgctgctgctgtgaccaggaatgctcatcaaatttaacaacgctgttcagacggtcctgcttcaccggcgtgtttggaggagacgtcaatcctccttttgatcagctctgctctgctgggacgacgacacgtggtgtccccgattggtttccctttctgtgtgtgcagtccccccttgccaacacacccttccttggttacttctatcatggtgctgtttcccccaaacaggactcttcctttgaagtatatgtggatactgacgcaaaagactttgcagactttggttacaaacaaggagatcccattatgactgtaaagaaggcatattttactattccgcaggtgtccctggctgggcagtgtatgcagaacgccccagtggcatttcttcacaattttgatgttaaatgcgttactaatttggaactataccaagaacgagatggtattatcaatgcgaagataaagaatgttgccttaggaggcatagttacaccaaaagtgatctatgaggaagcaactgacctagacaaattcatcaccaatacagaaactcctttaaataacggatcaacccctagaattgtgaatgtggaagaacattatattttcaaatggaataataataccatcagtgaaataaatgttaaaatttttagggcagagattaatgcccaccagaaagggataatgacacagagatttgtagtaaaatttttaagctataatagtggtaatgaagaagaattatctggaaatccaggttaccaacttggcaagcctgtccgagctctaaatatcaacaggatgaataatgtcacgactttacatctttggcaatcggctggaaggggtctgtgtacatcagcaactttcaaacccattttatttggagaaaatgtactctctggatgcctgttagaagtcgggattaatgaaaattgtactcagctcagggagaatgctgttgaaagacttgattcattaatacaagcgactcacgttgcaatgagaggcaactccgattacgctgatcttagtgatggctggctcgaaataatacgtgtagatgcccctgatccaggtgcagacccgctggctagcagtgtgaacggcatgtgcctggatattcctgctcacctgagcatccgcatcctcatctcggatgctggcgcggtggaagggattactcagcaggagatactcggtgtagagacaaggttctcctcagtgaactggcagtaccagtgtgggcttacctgtgagcacaaggccgaccttctccctatcagtgcatccgtccagtttattaaaattcctgcacagttaccccaccccctgacaagattccagatcaattatacagagtatgactgcaacagaaatgaggtgtgttggccgcagcttctatatccatggactcagtattatcaaggggagctgcattctcagtgtgttgctaagggcttactgttgctgttgttcctcacattggccttgttcctcagcaacccctggaccagaatatgcaaagcctatagttagacaaccacctggcttttatttttttgagatggagttttgctcttgttgcccaggctgaagtgatctcggctcaccacaacctcctcctcttgggttcaagcgattctcctgcctcagcctccggagaactgggattacaggcatgcaccaccacgcccggctaattttgtatttttagtagagacagggttccaccgtattggccaggctgctctcgaactcctgacctcatgatccgcccatcttggcctcccaaagtgctgagattacaggcatgagccaccgcacccggcctttttttttttttttttttttttgaggcggggtctctgtcacccaggctggagtgcagtgcacaatctcggctcactgcaatctctgcctcccaagcaatcctcccacctcagcctctggtgtagctgggaccacagatgctccaccatgcctggctgtatttttggtaaagacggggtttcgccttgttgcccagggtggtctgtaactcctgagctcagatgatctgcccacctcggcctcccaaagtgctgggatcacagacgtgagccactgcgtccggtccatctgacttctcaaagactttagaccttgacttcagtgatttgttgtagtcttgtatgcttctctataaaattttaataaatgaaatgtcttatttttgtagaaaatttt

SEQ ID NO: 189961 - DNA, 2513 bp, Homo sapiens
  Payload ID: 17508
  Gene Symbol: TCTN2
  Gene Name: tectonic family member 2
  Uniprot ID: Q96GX1
  ENST ID: ENST00000426174
  CDS Start-End: 129-2219
atagctccgggcgttcgcttgcaagatggcggcggcggggcagtggctgctgcgttttcgtgtctgagtccttcctgggttctaatgagggcgcggttctgctgtgcccggcccgcgaggtctaaggcatgggcttccagcctccggccgctcttcttttgaggcttttccttctgcagggcatcctgaggcttctgtggggggacctggctttcatccctccttttatccgaatgtccggccctgcggtcagcgcgtccctggtcggagacaccgagggtgtgaccgtgtccctggcagtgctgcaggacgaggcgggaatattgccaattccgacgtgtggagtgctgaacaatgagacggaagactggagcgtgactgtgatccccggtgcggtgttggaagtgacagtgaggtggaagagaggtctggactggtgttcctccaatgagacagattccttctcagagtccccctgtatcctccagacccttctggtttcagcatctcataattcatcctgttcagcacatctactcattcaagtggaaatttatgccaactcttctctgacccataatgcctcagagaacgtgactgtcattcctaaccaggtgtatcagccccttggcccttgtccttgtaatttaacagctggagcctgtgatgttcgctgctgctgtgaccaggaatgctcatcaaatttaacaacgctgttcagacggtcctgcttcaccggcgtgtttggaggagacgtcaatcctccttttgatcagctctgctctgctgggacgacgacacgtggtgtccccgattggtttccctttctgtgtgtgcagtccccccttgccaacacacccttccttggttacttctatcatggtgctgtttcccccaaacaggactcttcctttgaagtatatgtggatactgacgcaaaagactttgcagactttggttacaaacaaggagatcccattatgactgtaaagaaggcatattttactattccgcaggtgtccctggctgggcagtgtatgcagaacgccccagtggcatttcttcacaattttgatgttaaatgcgttactaatttggaactataccaagaacgagatggtattatcaatgcgaagataaagaatgttgccttaggaggcatagttacaccaaaagtgatctatgaggaagcaactgacctagacaaattcatcaccaatacagaaactcctttaaataacggatcaacccctagaattgtgaatgtggaagaacattatattttcaaatggaataataataccatcagtgaaataaatgttaaaatttttagggcagagattaatgcccaccagaaagggataatgacacagagatttgtagtaaaatttttaagctataatagtggtaatgaagaagaattatctggaaatccaggttaccaacttggcaagcctgtccgagctctaaatatcaacaggatgaataatgtcacgactttacatctttggcaatcggctggaaggggtctgtgtacatcagcaactttcaaacccattttatttggagaaaatgtactctctggatgcctgttagaagtcgggattaatgaaaattgtactcagctcagggagaatgctgttgaaagacttgattcattaatacaagcgactcacgttgcaatgagaggcaactccgattacgctgatcttagtgatggctggctcgaaataatacgtgtagatgcccctgatccaggtgcagacccgctggctagcagtgtgaacggcatgtgcctggatattcctgctcacctgagcatccgcatcctcatctcggatgctggcgcggtggaagggattactcagcaggagatactcggtgtagagacaaggttctcctcagtgaactggcagtaccagtgtgggcttacctgtgagcacaaggccgaccttctccctatcagtgcatccgtccagtttattaaaattcctgcacagttaccccaccccctgacaagattccagatcaattatacagagtatgactgcaacagaaatgaggtgtgttggccgcagcttctatatccatggactcagtattatcaaggggagctgcattctcagtgtgttgctaagggcttactgttgctgttgttcctcacattggccttgttcctcagcaacccctggaccagaatatgcaaagcctatagttagacaaccacctggcttttatttttttgagatggagttttgctcttgttgcccaggctgaagtgatctcggctcaccacaacctcctcctcttgggttcaagcgattctcctgcctcagcctccggagaactgggattacaggcatgcaccaccacgcccggctaattttgtatttttagtagagacagggttccaccgtattggccaggctgctctcgaactcctgacctcatgatccgcccatcttggcctcccaaagtgctgagattacaggcatgagccaccgcacccggcc

SEQ ID NO: 189962 - DNA, 556 bp, Homo sapiens
  Payload ID: 17508
  Gene Symbol: TCTN2
  Gene Name: tectonic family member 2
  ENST ID: ENST00000541523
  CDS Start-End: 129-311
atagctccgggcgttcgcttgcaagatggcggcggcggggcagtggctgctgcgttttcgtgtctgagtccttcctgggttctaatgagggcgcggttctgctgtgcccggcccgcgaggtctaaggcatgggcttccagcctccggccgctcttcttttgaggcttttccttctgcagggcatcctgaggcttctgtggggggacctgggtgtgtacggcgcggcagtgacctcgctttcatccctccttttatccgaatgtccggccctgcggtcagcgcgtccctggtcggagacaccgagggtgtgaccgtgtccctggcagtgctgcaggacgaggcgggaatattgccaattccgacgtgtggagtgctgaacaatgagacggaagactggagcgtgactgtgatccccggtgcgaaggtgttggaagtgacagtgaggtggaagagaggtctggactggtgttcctccaatgagacagattccttctcagagtccccctgtatcctccagacccttctggtttcagcatctcataattcatcctgttca

SEQ ID NO: 189963 - DNA, 2734 bp, Homo sapiens
  Payload ID: 17509
  Gene Symbol: TCTN3
  Gene Name: tectonic family member 3
  ENST ID: ENST00000265993
  CDS Start-End: 191-2068
ggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtactaa

SEQ ID NO: 189964 - DNA, 1464 bp, Homo sapiens
  Payload ID: 17509
  Gene Symbol: TCTN3
  Gene Name: tectonic family member 3
  Uniprot ID: Q6NUS6
  ENST ID: ENST00000371209
  CDS Start-End: 1-1332
atgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcagtatcctttttagagctgggtggcctgttgcagcctaatgagaaaagctgcaaaggctttcaaacttatgttagactagccaaaggtgaggaattttttgttcattataatgaggtacttatatactaatatatggttaatcatttttggaatctagttgtctctctgtggttttctgaggaaaaaaatcacaaatttgtgactcgaacattatgatagtaatacaaaataaatagcattaaaggagaatgagaacataaa

SEQ ID NO: 189965 - DNA, 2514 bp, Homo sapiens
  Payload ID: 17509
  Gene Symbol: TCTN3
  Gene Name: tectonic family member 3
  Uniprot ID: Q6NUS6
  ENST ID: ENST00000371217
  CDS Start-End: 25-1848
ggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtactaa

SEQ ID NO: 189966 - DNA, 1778 bp, Homo sapiens
  Payload ID: 17509
  Gene Symbol: TCTN3
  Gene Name: tectonic family member 3
  Uniprot ID: Q6NUS6
  ENST ID: ENST00000430368
  CDS Start-End: 28-1407
gtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactgtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggaggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacactt

SEQ ID NO: 189967 - DNA, 2739 bp, Homo sapiens
  Payload ID: 17509
  Gene Symbol: TCTN3
  Gene Name: tectonic family member 3
  Uniprot ID: Q6NUS6
  ENST ID: ENST00000614499
  CDS Start-End: 245-2068
ggttgccaggcaacggaggcacggcccggcccgcgttaaggaggagggcgcagaccgaaggacactgaaagagctgtaacaaccccactttcgattggttgaagagctctcagccttctcatgagccaatgagaagaggcacgcggatggcgtcagacgctatgcgactcctcccacccacgctctggcaatgcgattggagaccgcggaggcctacgtcggacccggaggccctgaatgccccatgcgcaccccacagctcgcgctcctgcaagtgttctttctggtgttccccgatggcgtccggcctcagccctcttcctccccatcaggggcagtgcccacgtctttggagctgcagcgagggacggatggcggaaccctccagtccccttcagaggcgactgcaactcgcccggccgtgcctggactccctacagtggtccctactctcgtgactccctcggcccctgggaataggactgtggacctcttcccagtcttaccgatctgtgtctgtgacttgactcctggagcctgcgatataaattgctgctgcgacagggactgctatcttctccatccgaggacagttttctccttctgccttccaggcagcgtaaggtcttcaagctgggtttgtgtagacaactctgttatcttcaggagtaattccccgtttccttcaagagttttcatggattctaatggaatcaggcagttttgtgtccatgtgaacaactcaaacttaaactatttccagaagcttcaaaaggtcaatgcaaccaacttccaggccctggctgcagagtttggaggcgaatcattcacttcaacattccaaactcaatcaccaccatctttttacagggctggggaccccattcttacttacttccccaagtggtctgtaataagcttgctgagacaacctgcaggagttggagctgggggactctgtgctgaaagcaatcctgcaggtttcctagagagtaaaagtacaacttgcactcgttttttcaagaacctggctagtagctgtaccttggattcagccctcaatgctgcctcttactataacttcacagtcttaaaggttccaagaagcatgactgatccacagaatatggagttccaggttcctgtaatacttacctcacaggctaatgctcctctgttggctggaaacacttgtcagaatgtagtttctcaggtcacctatgagatagagaccaatgggacttttggaatccagaaagtttctgtcagtttgggacaaaccaacctgactgttgagccaggcgcttccttacagcaacacttcatccttcgcttcagggcttttcaacagagcacagctgcttctctcaccagtcctagaagtgggaatcctggctatatagttgggaagccactcttggctctgactgatgatataagttactcaatgaccctcttacagagccagggtaatggaagttgctctgttaaaagacatgaagtgcagtttggagtgaatgcaatatctggatgcaagctcaggttgaagaaggcagactgcagccacttgcagcaggagatttatcagactcttcatggaaggcccagaccagagtatgttgccatctttggtaatgctgacccagcccagaaaggagggtggaccaggatcctcaacaggcactgcagcatttcagctataaactgtacttcctgctgtctcataccagtttccctggagatccaggtattgtgggcatatgtaggtctcctgtccaacccgcaagctcatgtatcaggagttcgattcctataccagtgccagtctatacaggattctcagcaagttacagaagtatctttgacaactcttgtgaactttgtggacattacccagaagccacagcctccaaggggccaacccaaaatggactggaaatggccattcgacttctttcccttcaaagtggcattcagcagaggagtattctctcaaaaatgctcagtctctcccatccttatcctgtgcctcttactacttggagttctcaacctagagactatgtgaagaaaagaaaataatcagatttcagttttccctatgagaaactctgaggcagccacttatcttggctaaatagaacctcacctgctcatgaccagagagcatttaggataatagaggacctaactgaaggaatccttgtatatgaaaggagttattttagaaaagcaataaaaatattttattcatcatagctctctgctttgggctctgcaggccaccagatacacatgaggcccctacttctcaagctgggaaggccaagagccttccttcagcctttctggttatgttacacctagctgaatgtttacaaggtctggatccatcagccctcaggcacagttgggccaagcagaaagagagaaacacttctgctgtcaccttgaatgaactcaggaatagcttccctctggactgtagaggagctaactgtttggaacagaaaactgctggctgttgattttgtctggttcctttgccaacatctgggcacaccctttgcccagacacgagtggggaaagcagttctttctcctcagtttccaaagtaaatggggaatcccagctttcttttctactagcaaatgaccctaccatttatttctgcctttttcttccgttcattgtgaggaaaaataaaactggttgagagctttgttgtactaattcca

SEQ ID NO: 189968 - DNA, 655 bp, Homo sapiens
  Payload ID: 17510
  Gene Symbol: TECPR1
  Gene Name: tectonin beta-propeller repeat containing 1
  ENST ID: ENST00000420697
  CDS Start-End: 367-655
agagtggcgccccagctgcagcggcggccagggccgtgggaaagaatggggcgatgaagggctgggcacgccgccttccccaccacccccaggctgtttgctcgcggggagggaggaaggagggaccgcacttgtcatctcgcctgcacacctggaaggtgccgcccccgtcccctgccctggaacgcccacaggctagcgaagttgcctggtgcaggaccctgatgtcgcttttgaacagcccctgcacctggcagccagcgagctactgtagtaggcattgccgactgtttgcataccggatgggagtgacagtgtaatagaaaaacaagcaagaaaccttttaggttacctccagccgctgccatgcccaactcagtgctgtgggcggtggacctcttcgggagagtgtacacgctgtccacagcaggccagtactgggaaatgtgcaaggactcccagctggagttcaagcgcgtcagcgccaccacgcagtgctgctggggcattgcctgtgacaaccaggtctacgtgtatgtgtgtgccagcgatgtccccatccgccgccgagaggaggcctatgagaatcaggcttgggtccaaggccgcctctgtgtccccggccctcagcgctggaatcccatgggcggcttct

SEQ ID NO: 189969 - DNA, 6564 bp, Homo sapiens
  Payload ID: 17510
  Gene Symbol: TECPR1
  Gene Name: tectonin beta-propeller repeat containing 1
  Uniprot ID: Q7Z6L1
  ENST ID: ENST00000447648
  CDS Start-End: 301-3798
aatgggcacggggcctgatgccgcttccggcccaccctcttgcccggtccccgggagggccggtccgctcctcccggacgccgaggacctaccaccgcgacttcgccccgcccggcgcgggcccaggaccctgatgtcgcttttgaacagcccctgcacctggcagccagcgagctactgtagtaggcattgccgactgtttgcataccggatgggagtgacagtgtaatagaaaaacaagcaagaaaccttttaggtaggactcctaaggctcagaggaagttacctccagccgctgccatgcccaactcagtgctgtgggcggtggacctcttcgggagagtgtacacgctgtccacagcaggccagtactgggaaatgtgcaaggactcccagctggagttcaagcgcgtcagcgccaccacgcagtgctgctggggcattgcctgtgacaaccaggtctacgtgtatgtgtgtgccagcgatgtccccatccgccgccgagaggaggcctatgagaatcagcgctggaatcccatgggcggcttctgtgagaagctcctgctgagtgaccgctgggggtggagtgacgtgagtgggctccagcaccggccgctggacagggtggcactgccctcgccgcactgggagtgggagtctgactggtacgtggatgagaattttggaggtgaacccactgagaaaggggggtggacgtacgccatcgactttcccgccacctacacgaaagacaagaagtggaattcttgtgtgcggcgccggaagtggatccggtacaggagatacaagtcccgggacatctgggccaagatcccctcgaaggatgaccccaaggagctgcccgaccccttcaacgacctctctgtagggggctgggagatcacggaggagcctgtgggccgcctgtcagtgtgggctgtgtctctgcagggcaaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctgctaaaaatacaaaaaaaaaaaaattagctgggcatggtggtgggtgcctgtaatcccagctactcgggaggctgaggcaggagaatcgtttgaacccgggaggcggaggctgcagtgagccgagatcatgccactgcactccagcctgggcgacagagactccatctcaaaaaaaaaaaaaaaaaaaagtgaaggaaggagacagcagattggaaataacactggagtggatgggatgtcctcttccctgagggggccggggtaccagacgggaggctgggagaggatgagaggctgccccatggctggaggcagtgtccgtgtgtgcagtcaccatcatcaacccccattcggccccttccccagatgcgctggtgacaggggcttcttggatgtcaaatcatgttgtaggagggtgcagactgcgggcttctgtggggagcagtactactgtgtctgtcggcagtggccatgggaccctcagcccgtcctgtacatggagcagggtgcacagtcaccctccatcctgtggcgagaggctggcccggcccggccaggcgaggcagaaggtgtcggccaagtggccccgaccccatcccgcagtctctcagctgctttttattacctctgtgccccatttgggagtttgcttcctccacctggacactttgcccgggaggtcatcagagcccaaccccaggctctgctcggttggagaggggatgacttcaccaccacctgaccttcctagggtcctggtctcactgtcagctgggggtccgttgtgtgtatttgtacagttttgctgtatggggtttgtcacccaaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactatcaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagacattgctgtgaaatcttttatttttgttttatgacacagcatcaatttcatgaatactttgaaagggccattagaaaaaataagagccaatttgggtcatttgagaaacattttcagcacaattacagtgggggcacgggccgttcggctccagctgggttttcccagatgcaacaatcgcggttctggcttctccactggtggggatggggatcgcgccttcggagctctcagggcgcctgtctgtcgggggctgggtgcgtccacagccccgggggatggcgcgtggcgtagcccaggaacggcatgtgggtgggtctctgacctgcttgtgcagggacttgagggacctcatcccgatggccgaggcaggggctccccacgggataaaaggatccggcctggccttggggtccaagaggagggccaagggagtggacctggcccctgtcccctctcctcctcgaaacactggacaccctgaagcgagactatggctgctgaggatcctgtgtgatgtggccgcggggcgtcccctctggcctcaggggaagaaggactgggcggctcggcccaggtcaccctctaggaagcagaggaggtgcaggtgccagttcagggcagaaagaaagagccactgaggccattgtcctgaaggcggtgacccccaggcactcctgctgccccccaggaagccctgggctgcgctggacaccgggccgagtctccgtcttctggaccgaggctcttctgggctttcaggctcagctcgtcggtccattcagcaagttcaggggcagactgagccctgctctggccat

SEQ ID NO: 189970 - DNA, 590 bp, Homo sapiens
  Payload ID: 17510
  Gene Symbol: TECPR1
  Gene Name: tectonin beta-propeller repeat containing 1
  ENST ID: ENST00000423128
  CDS Start-End: 288-590
acaggctagcgaagttgcctggtgcaggtgacgcccccattccagcctttggactggagccataggagaagcggatcgcgggatcctggttgttttcgagaatcacgcagcaaggggcctgcctatccctctccctgggaccctgatgtcgcttttgaacagcccctgcacctggcagccagcgagctactgtagtaggcattgccgactgtttgcataccggatgggagtgacagtgtaatagaaaaacaagcaagaaaccttttaggttacctccagccgctgccatgcccaactcagtgctgtgggcggtggacctcttcgggagagtgtacacgctgtccacagcaggccagtactgggaaatgtgcaaggactcccagctggagttcaagcgcgtcagcgccaccacgcagtgctgctggggcattgcctgtgacaaccaggtctacgtgtatgtgtgtgccagcgatgtccccatccgccgccgagaggaggcctatgagaatcagcgctggaatcccatgggcggcttctgtgagaagctcctgctgagtgaccgctgggggtggagtgacgtgagtgggctc

SEQ ID NO: 189971 - DNA, 552 bp, Homo sapiens
  Payload ID: 17510
  Gene Symbol: TECPR1
  Gene Name: tectonin beta-propeller repeat containing 1
  ENST ID: ENST00000415086
  CDS Start-End: 256-552
ggtccccgggagggccggtccgctcctcccggacgccgaggacctaccaccgcgacttcgccccgcccggcgcgggcccaggaccctgatgtcgcttttgaacagcccctgcacctggcagccagcgagctactgtagtaggcattgccgactgtttgcataccggatgggagtgacagtgtaatagaaaaacaagcaagaaaccttttaggtaggactcctaaggctcagaggaagttacctccagccgctgccatgcccaactcagtgctgtgggcggtggacctcttcgggagagtgtacacgctgtccacagcaggccagtactgggaaatgtgcaaggactcccagctggagttcaagcgcgtcagcgccaccacgcagtgctgctggggcattgcctgtgacaaccaggtctacgtgtatgtgtgtgccagcgatgtccccatccgccgccgagaggaggcctatgagaatcaggcttgggtccaaggccgcctctgtgtccccggccctcagcgctggaatcccatgggcggcttctgtgagaag

SEQ ID NO: 189972 - DNA, 8686 bp, Homo sapiens
  Payload ID: 17511
  Gene Symbol: TECPR2
  Gene Name: tectonin beta-propeller repeat containing 2
  Uniprot ID: O15040
  ENST ID: ENST00000359520
  CDS Start-End: 227-4462
cccccggcggagccagctgctgctcttcggtgctggccccggtgccggccccgttgcccagggaacaggctcccggcagcccccgcggcccggagtccatcccgcctcctccggcccggcggggccgacgagtccggaggggctgccgcgggagcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggggaagacggaatctatcactgtggtgaagctgctgagctgctttgatgacctggtggcagcaggcacagcctctggcagggttgcagtttttcaacttgtatcttcattgccagggagaaataaacagcttcggagatttgatgtcactggtattcacaaaaatagcattacagctctggcttggagccccaatggaatgaaattgttctctggagatgacaaaggcaaaattgtttattcttctctggatctagaccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggccacagttgctggtttggaaggatccggtgatattgtgtctgtttcgtgcacagaaaatgaaatatttttcttgaaaggagataggaacattataagaatttcaagcaggcctgaaggattaacatcaacagtgagagatggtctggagatgtctggatgctcagagcgtgtccacgtgcagcaagcggagaagctgccaggggccacagtttctgagacgaggctcagaggctcttccatggccagctccgtggccagcgagccaaggagcaggagcagctcgctcaactccaccgacagcggctccgggctcctgccccctgggctccaggccacccctgagctgggcaagggcagccagcccctgtcacagagattcaacgccatcagctcagaggactttgaccaggagcttgtcgtgaagcctatcaaagtgaaaaggaagaagaagaagaagaagacagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggggcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacatcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccacgggcttccttcttcatcctcagagacgagtgtgacagagctcggacctagttgctcccagcaggacctgagccggctgggtgcagaggacgccgggctgctcaagccagatcagtttgcagaaagctggatgggctactcgggtcccggctatggcatcctcagcttggtggtctccgagaagtatatctggtgcctggactacaaaggcggcctgttctgcagcgcgttgccgggcgccgggctgcgctggcagaagtttgaagatgctgtccagcaggtggcagtctcgccctcaggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtctgagcgtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcagcgaaaggcaagctttagaacccgtctgcataacgctcggggatcagcagactctctgggccctggacatccatgggaacctgtggttcagaactggcattatttccaagaagccccaaggagatgacgaccattggtggcaagtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggcacctactggaatcatgtggttccccgtgggacagcttctgctacaaaatgggcctttgtgttggcttctgcagctcccacgaaggaaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccagcccgccggggtcagcttggtcagcgtccattccagccccaacgaccagatgctgtgggtgcttgacagcaggtggaacgtgcacgtgcggaccgggatcaccgaggagatgcctgtggggaccgcctgggagcatgtgccagggttgcaggcctgccagctggcgctgagcaccaggaccgtgtgggcccgctgtccaaacggagacctcgcccggcggtacggcgtcacagacaagaaccccgccggggactactggaagaaaattcccggcagcgtgtcgtgtttcacagtgactgcgtcagatgagctgtgggctgtgggcccgcccggctacctcctccaacggctgacaaagacgttcagccactcgcacggcacccagaagagcagccaggccgccatgccccaccctgaggacctggaggacgagtgggaggtcatctgaaggagccctggccgagtcacgcggaggggcccggcgtctgtggcgggcacaggggcttcagagtgactccctggtggacgcgctgcctcaacacttgtccagacacctctggccaggttggacccgcacacttactttcatctatgttggtttctgtctcgttccagaacccacagcctccacccgtggctggcgtgattgctgcagcagtggcgcctcctagctcaggacagtggcgactgcccggctgcatgcactccgattacccacgtgctgccgtcctggtctcatccacagatagctccagcttttgttggtgggagtggtctccggaggcctcccagaaccaagggtagccgggcagctggtttggcccagggcctccttccacattagtagccccagggccagatggagccaaaggtcagctctctgcagcgcgggatgtgctcggtgatggctttgtcccatcataggggggtgtccccccagagacaaagctgcagagcacattccatgccagacgctctggccaggaagctgaggccgggcttgagaggagagcgctggccatgccaggagagaacccacgcacatgcacaccacaacacacaacacacctcacctcacaccacagcacacctcaccacaccacaccgcactgcaccatacctcaccacatctcaccacaccacagcacacctcaccacacaacacaccacaccccacaccgcactgcaccgcaccgcaccgcaccgtacctcgccacatctcaccacaccacaccacaccacacctcactgcccacacacggcgcaggctgcccgcctcctggagagcacacttcagctgaaacagtaaagcctgatgggtgcaaatggaacctggatgtgtgcacgtgtgtcccaggtagggacggcacaggagggtgcatggggcgtgggggagctgagcaagggtcgctcacttagaaatgtctttggaatggtgtttaactaatgctgctggcggacatcctaaaaccagatgcatcctcagaggacgagtctactaattattgcctttgttgttgtattacaaatctgcataaaatacctcatttcaaatcaaatcttacaaatttagaagagagatatgttttccgaaaacagtggaagccctttgttccttcccgggtttgtcctgagcctgcactgtcctcgcctgcagcctcagaggggcaggcatccccgcacagacttgactggcagggcggtcacgggacctgcgggctggctccgagtggcagcccatgccttctgcggggtatgggttgacacttgacaggttgaaaccagtgcctctatggacggctgctgtggccccttcagacaatgggcagtgcccaccccgcccactggcatctgcgtgtgagggctaggccgccctgccacacatcccgccccctcccggaggcagcttcaggacaggacaccaggctggctgctttttttagcctgcccctggcccaggcccagtccttggtgtcagggagcccccaggccgcaggtggagggtgataaaatatgttctctgacaggacccagccagccacataggtggaggttttccatgtccaaatgaggtcaagatgccgaaatcccagatctgacttcacacttcccttttctagaaccttttgtaaaagttggtggcagcagaggcagccccaggccgggctgcatctctctgtgtctgttgtgccttgcccggcgcctcacggatggcaaagctctcctcacccatgggactgtagtgcaattaaacccgcgtctaggtgatgcttttaaagttgtagcttcgtgctttgtacagttttctttctggttttaatttttagttgtgctttgagtcagtgcaataaactagactttttccaaacctggccgagtgtggtgcctgagctgtgagaagtgtcctcagccgacactcacgagggcagtgcaagggagaacctgccagcccagccccaccacagggagagtgcgtcagcagacctgtcctggcctggctggtgttgaaatacacaccggtttgcccaagtggctgttatgggggaatggccgctccagagctggctgtaccccatggtagcctctgaggaggacgctgtggggtgaggtccagggctgcctcctcatggagctgtgtgtgagcaggcgttggaggggttcgagcccctggttctgtatcttcagccagcaaacgaaaccatatcgcaaaccagagctgctggaaaccagcacacgcaaaagatgacgcccagcacagcagcaggacacaccatgtgccaggaaatgacctcagcaagaaacctcaggccgtgtgaagagcagcaaagctttccagaaggcataaaaggaaacttgaataaaggaagatatgttccacattcctggatggaggactacacacattatggaaagacctcattctttccaaaggaatttataggtgtagcttgatttcagttcaaatccccactgggattgttttgttggggcaggcagggaggaataatgttagtacccacaaatgcccatgactgtgcccaatgtgcttctcaccagagccctgcaaggggaagtctcattagccccttgagactcagagaggttaggtaacttgctcaaggtcacacagcactgggactggaagccagctctgtagaactgcagacctgtgctgtttgatgcctcctcactgtcccgtcactcctgggaagaagaaacgggtgagaactgctaagtgatgacaggtggagccccagcaggggccactctattgaatggcatggcccagaccctcggagggccaggcaacaggctagcaaggcccacagggagggagcagaatggagagggcatctcagatgcgcttaaggagcggcgggggcggggcatggggggtgtcacaactaatgtggccactgcttcattctctgggcaaaataatattaaatggattaaagaatctaaaaccagtgggaaaactgtctgatttctggatggcaaaggctttctaaactcaaaagtgataggacaagctacagaggaaaataagtacatagatttgatttctccaaaatacagaaatgctgctgggcacagtgatgtgcagttatagtcccagctacttgggaggccaaggcaggaggattacttgagcccaggagtttgaggctgcaatgaactatgatcacaccactgcactccagcctcggcgacagagcaagaccttgtttctcaaaaataaataaatagaaggaaataaatgtaaaaatgctgcaaattaaaaacctcaaagaagggaaataattgcaacaaatgggaattgatgttgaatatttaccttaaaaacctatacaacaataagaggagtgcgcccttcagcagcatgtatacaaaaattgcaacgatacagagattagcatggcccctgcacaaggatgactcgcaaattcataaagctttccataaatatatttattaaaaaccaataggaggagcacttcgagtcgagtgtaagggcccttcacaaaagcagaaggaacactggcccaaacccccagcaccccggaagcagaggtgagatgggagcagcttgggagccccccattggcgccgccctactggggaagccggtccgtacgtaggccttgcatctcgccacctccacttctgtcctcaagaacaagtcctaggtcaagggaaacagcacagcctgtttataattaggaaacacttaaaacagcctggcatttgggaacagccatgttaacgtgagcaaattcctctcatgaaatagcctgcagctattaagaagcacgtgtgtgcaggaagcggaggcgcaggacctcaccgcgccagcgtgaagttcccgggcatggtcatgaaagcgtggttctgtaagaaatcagagggagaaagggagagaagggggagggagacaacccaaacgttggagggtatttgttgtaaacttcaaacttttggcaggtttgaaatttttcataactccggggaggagcaagaggggtgaaaagaaacaagttctctacttgtgatcagcagctggtcatagtggttgcctggagtatatgcctttttgtatcctttgaatttccagccatgtaaatgtattatttattccaaaaataaagcagatttacattttaaaaattca

SEQ ID NO: 189973 - DNA, 4281 bp, Homo sapiens
  Payload ID: 17511
  Gene Symbol: TECPR2
  Gene Name: tectonin beta-propeller repeat containing 2
  Uniprot ID: O15040
  ENST ID: ENST00000558678
  CDS Start-End: 111-3914
cggcggggccgacgagtccggaggggctgccgcgggagcccccaggtttccctagatgacaaataaacattccttttcctgcgtgaagatagtctgtggaaaccttggccatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggggaagacggaatctatcactgtggtgaagctgctgagctgctttgatgacctggtggcagcaggcacagcctctggcagggttgcagtttttcaacttgtatcttcattgccagggagaaataaacagcttcggagatttgatgtcactggtattcacaaaaatagcattacagctctggcttggagccccaatggaatgaaattgttctctggagatgacaaaggcaaaattgtttattcttctctggatctagaccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagccttttgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggccacagttgctggtttggaaggatccggtgatattgtgtctgtttcgtgcacagaaaatgaaatatttttcttgaaaggagataggaacattataagaatttcaagcaggcctgaaggattaacatcaacagtgagagatggtctggagatgtctggatgctcagagcgtgtccacgtgcagcaagcggagaagctgccaggggccacagtttctgagacgaggctcagaggctcttccatggccagctccgtggccagcgagccaaggagcaggagcagctcgctcaactccaccgacagcggctccgggctcctgccccctgggctccaggccacccctgagctgggcaagggcagccagcccctgtcacagagattcaacgccatcagctcagaggactttgaccaggagcttgtcgtgaagcctatcaaagtgaaaaggaagaagaagaagaagaagacagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccacaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggggcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacatcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccacgggcttccttcttcatcctcagagacgagtgtgacagagctcggacctagttgctcccagcaggacctgagccggctgggtgcagaggacgccgggctgctcaagccagatcagtttgcagaaagctggatgggctactcgggtcccggctatggcatcctcagcttggtggtctccgagaagtatatctggtgcctggactacaaaggcggcctgttctgcagcgcgttgccgggcgccgggctgcgctggcagaagtttgaagatgctgtccagcaggtggcagtctcgccctcaggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtctgagcgtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcagcgaaaggcaagctttagaacccgtctgcataacgctcggggatcagcagactctctgggccctggacatccatgggaacctgtggttcagaactggcattatttccaagaagccccaaggagatgacgaccattggtggcaagtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggcacctactggaatcatgtggttccccgtgggacagcttctgctacaaaatgggcctttgtgttggcttctgcagctcccacgaaggaaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccaggtaagcagaagttagctggtggaactcactcttcagtaagacagaaactgtgaggatgctggtactgggaaaaaggatctgcacagcctctagaggcctcccagcaaatgcggggagccatgcccccagggtctacacactctcgttcatcaacatcacaactggaattcgggatttgtgaagtttagagctgaacagactgttacagattatgagtcaacacgtatattttctctttcaaaataataatatttcgtttttgactttttactaagtgaatattattttttaaatctgcctatatattggaacctctattttataataataatgataataaatcagtacccagaagtataaagaaggtaaaagttactttgaa

SEQ ID NO: 189974 - DNA, 6468 bp, Homo sapiens
  Payload ID: 17512
  Gene Symbol: TECTA
  Gene Name: tectorin alpha
  Uniprot ID: O75443
  ENST ID: ENST00000264037
  CDS Start-End: 1-6468
atgaattattcatcattccttagaatttgggtctctttcatcttcgcacttgtacagcaccaagctcagcccagggagctcatgtatccattttggcagaatgacaccaaaacccctaaagtagatgatggaagctcatctgagattaagttggccatcccagttttcttctttggcgttccttaccgcactgtctatgtcaataacaacggagttgtttccttcaatgtgctagtgagccagttcacgccagaatcctttcccctgacagatgggagagccttcgtcgccccattttgggcagatgtgcacaatggaattcgaggcgagatctattacagagagaccatggagcctgccatcttgaaaagagccaccaaggacatcaggaagtacttcaaagacatggcaaccttctctgccacttgggttttcattgtgacatgggaggaagtcacgttttatggaggcagcagcaccacacctgtgaacaccttccaggccgtcctagtgtccgatggctcctatacattcaccctcttcaattattacgaaatcaactggaccacggggacggcgagtggcggcgaccccctgacaggtcttggtggagtgatggcacaggcaggatttaatggtggaaacctcaccaatttcttcagcctcccggggtcaagaacccccgagatcgtgaatatccaggagaccacaaacgtcaatgttccaggccgctgggcatttaaagttgatggaaaggaaattgacccagccaatggctgcacctcaaggggacaattccttcggcgaggggaggtgttttgggatgacttgaactgcaccgtcaagtgccgctgtctggatttcaacaatgagatctactgccaggaggcttcctgtagcccctacgaggtgtgcgaacccaaaggcaaattcttctactgcagcgctgtggagaccagcacatgcgtggtgtttggggagccacactaccacacttttgacggcttcctcttccacttccaaggctcctgtgcctacttgctggcccgacagtgtttgcagacttccagcctccctttcttcagtgtggaggccaagaatgaacaccgcagaggttcagccgtctcctgggtgaaggagctctcagtggaggtgaatggctacaagattctcatccccaaaggaagctatggaagagtcaaggttaatgacctagtgacttctttgcctgtcaccttagacttggggacagtgaaaatctaccagagtggcatatctactgccgtggaaacagattttgggctcttagtgacttttgatggccagcactacgcctccatttccgtcccaggctcctatataaactccacctgtggactctgtggaaactataataaaaacccactggatgacttcctccgcccggatggcaggccggccatgtctgtcctggatctgggagagagctggcgtgtgtaccacgcagactggaagtgcgactccggctgcgtcgacaactgcacccagtgcgacgctgccactgaagccctctactttggctctgactactgcggcttcctcaacaagacagacggccctctgtgggagtgtggcactgtcgtggaccccactgcttttgtgcacagctgcgtgtatgacctgtgcagtgtgagggacaatggcacgctcctctgccaagccatccaggcctatgctcttgtgtgccaagcccttggcattccaattggagactggcgaacccagactgggtgtgtgtccacagtgcagtgcccgagcttcagccactactccgtgtgcacaagcagctgccccgacacatgctccgacctgacggcctcgcggaactgcgccacgccgtgcacagagggctgcgagtgcaaccagggcttcgtcctcagcaccagccagtgcgtccctctgcacaagtgcggctgcgacttcgacggccactactacaccatgggggagttcttctgggccacggccaactgcactgtgcaatgcctgtgcgaggagggcggggacgtctactgcttcaacaagacctgcggcagcggggaggtgtgcgccgtggaggacggctaccagggctgcttccccaagcgggagaccgtgtgcctgctcagccagaaccaggtgctgcacacctttgacggcgcctcctacgccttcccctccgagttctcctacaccctcctgaagacctgccctgagcgcccagagtacttggaaatcgacatcaacaagaagaagcccgatgcaggacctgcttggctgcggggacttcggatcctggtggccgaccaggaggtcaagataggaggcatcggggcttcggaagtcaagttgaatggtcaggaagtggaattgccttttttccatccttcggggaagctggaaatttatcgaaacaaaaacagtacgacagtggagtccaagggcgtggtgactgtccagtactcagacataggtctattgtacatccggctgtccaccacatacttcaattgcacagggggcttgtgcggcttctacaatgccaacgccagtgacgagttctgtctccccaacggcaagtgcacggacaacctggcagtgttcctggaaagctggacaactttcgaggagatctgcaatggagagtgtggggacctgctgaaggcctgcaacaatgactcggagctgctcaagttttatcgaagccgctccaggtgcggcatcatcaacgacccctccaacagctccttcctggagtgccatggggtggtgaacgtcactgcctattaccgcacctgccttttccgcctgtgccagagtgggggcaatgagtcagagctctgtgactctgtggcccggtatgcaagcgcctgcaagaatgcggacgtggaggtggggccctggcggacctatgacttctgcccactggagtgcccagagaacagccactttgaggagtgcatcacatgtacagagacctgtgagacccttaccctgggccccatctgcgtggatagctgctctgagggatgtcagtgtgatgagggctatgctctactgggcagccagtgtgtcacgcggagtgagtgtggctgcaactttgaggggcaccaacttgccaccaatgagaccttctgggtggacctggactgccagatcttctgctattgcagtggcacagacaacagggtccactgcgagaccattccctgcaaggatgatgagtactgcatggaggaaggtggcctgtactactgccaagcccgcaccgacgcctcctgcatcgtctcaggctacggccactacctcacctttgatggcttcccctttgacttccagaccagctgcccactcatcctgtgcaccacaggaagcaggccaagctcagactctttccccaagtttgttgtcacagccaagaatgaggaccgggacccgtcactggccttgtgggttaagcaggtggacgtgaccgtgtttggctacagcatcgtgatccaccgagcttacaagcacactgtgctggtcaacagtgaacggctctatctgcccctgaagctggggcaagggaagataaatatcttttcctttggcttccacgtggtggtggaaactgattttggcctgaaggttgtatatgactggaagaccttcctgtccatcacagtccctcggagcatgcagaacagcacctatggtctgtgtggccgctacaacggcaaccctgatgatgacctggagatgcccatgggtctgcttgcatcgagtgtcaatgagtttgggcagagctgggtgaagagggacaccttctgccaggtgggctgtggggaccgctgtccgtcctgtgccaaggtggaaggtttctccaaagtgcagcagctgtgcagcctgatccccaaccagaacgctgccttctccaagtgtcacagcaaagttaaccccaccttcttctataagaactgcctgtttgactcttgcatcgatgggggcgcggtgcagaccgcctgcagctggctgcagaactacgccagcacctgccagactcaggggattacggtgactggctggaggaattacacgtcctgcactgtcacctgccctccaaacagccattacgagagctgcgtgagtgtctgccagccccgctgcgccgccatccgcctgaagagtgactgcagccactactgcgtggagggctgtcactgcgacgctggctacgtcctcaacggcaagagctgcatcctgccccacagctgcggctgctactccgatggcaaatattacgagcccaagcagctattttggaacagcgactgcacgcggcgctgccgctgtttccgtcgcaacgtgattcagtgcgacccgcgccaatgcaagtcagacgaggagtgtgcgctgcgcaacggggtgcgcggctgcttcagcaccaagacctcctactgcctggcggccggcggcggcgtcttccgcaccttcgacggcgccttcctgcgcttcccagccaactgcgccttcgtgctgtccaccatctgccagaaactgcccgacatctccttccagcttatcatcaacttcgacaagtggtcggcccccaacctcaccatcatttcgcccgtctacttctacattaacgaagagcagattctcatcaacgaccggaacacggtcaaggtgaatggcacacaagtgaatgttccatttataactggtttggcaaccaaaatctacagcagtgaggggtttctggtgattgacaccagcccagacatccagatatactacaatggtttcaacgtcattaaaatcagcatcagcgagaggctgcagaacaaagtgtgcggtctctgtggcaacttcaacggggacctaacagatgattatgtgaccttgcgagggaagccggtggtaagcagcgtggtgctggcccagagctggaaaaccaatggcatgcagaagagacctcttgcccccagctgcaacgagctgcagttctcacagtatgcagccatgtgtgacaatgtgcacatccagaagatgcagggtgatggctactgcctgaagctcaccgacatgaagggcttcttccagccctgctatgggcttctcgatcccctcccattctacgagtcctgctacctggacggctgctacagccacaagaagttccagctgtgcggctccctggccgcctacggggaggcctgccgctccttcgggatccttagcaccgagtggattgagaaggagaattgctcaggagtggttgaagatccctgtgtgggggcggactgtcccaaccgaacttgcgagctgggcaatggcagggagctgtgtggctgcatcgagccacccccctatggaaataactcacatgacattatcgatgcagaggtgacctgcaaagcagcccaaatggaagtgtccatatctaagtgcaagctcttccagctcggttttgagagggagggcgtgaggatcaatgacagacagtgcaccggcatcgagggggaagattttatctcctttcagatcaacaacaccaaagggaattgtggaaacattgtgcagtccaatggcacgcatatcatgtataaaaacacactctggatcgaaagcgccaacaacactggcaacatcatcaccagggaccgcacgatcaatgtggaattttcatgtgcttatgagctggatatcaagatctccttggattctgttgtgaagcctatgctaagtgtaattaacctgacagttccaacccaagaaggcagcttcatcaccaagatggctctctacaaaaacgcctcctacaaacatccttaccgccagggtgaagtagtgttgacgactcgagatgtgctgtatgtaggggtttttgtggttggagctgacgccacacatttaatcctaacactcaacaaatgctatgccacacccacccgagatagcaatgataagctccgatatttcatcattgaaggagggtgtcagaacctcaaagataacaccattggcatcgaggagaatgcagtctccctgacctgtcgctttcacgtcaccgtctttaaattcataggggattacgacgaagttcaccttcactgtgcagtgtcactctgcgactcagaaaagtactcctgtaaaatcacttgcccacacaattccaggattgccacagattacacaaaagagcccaaagaacagatcatttcagtgggacctattaggagaaaaaggctggactggtgtgaggacaatggagggtgtgagcagatttgcacgagccgggtggatgggcctctctgcagctgtgtaacaggaaccctgcaggaggacggcaagagctgcagagcctctaattcttcaatggaacttcaagtctggacgcttcttctcatcatgatccagatttcattatggcattttgtctataaatcaggcacgacctcataa

SEQ ID NO: 189975 - DNA, 7426 bp, Homo sapiens
  Payload ID: 17512
  Gene Symbol: TECTA
  Gene Name: tectorin alpha
  Uniprot ID: O75443
  ENST ID: ENST00000392793
  CDS Start-End: 272-6739
cgcaatcctgaaactgatctttagatttacttttccttaatcaatagaaaaaaacttgattgcagctcaacacttacctgtctctagtgcaggactaacttaatttttggttttaagagtacgagattcagacattatttcaggaatcagaaattattggcaacaagttgaggagaactgacatgaattcttgttttacctaattttttctggcttaccaagatttggcttaatatttctgactcagttcctccagcctctacagaacaggatgaattattcatcattccttagaatttgggtctctttcatcttcgcacttgtacagcaccaagctcagcccagggagctcatgtatccattttggcagaatgacaccaaaacccctaaagtagatgatggaagctcatctgagattaagttggccatcccagttttcttctttggcgttccttaccgcactgtctatgtcaataacaacggagttgtttccttcaatgtgctagtgagccagttcacgccagaatcctttcccctgacagatgggagagccttcgtcgccccattttgggcagatgtgcacaatggaattcgaggcgagatctattacagagagaccatggagcctgccatcttgaaaagagccaccaaggacatcaggaagtacttcaaagacatggcaaccttctctgccacttgggttttcattgtgacatgggaggaagtcacgttttatggaggcagcagcaccacacctgtgaacaccttccaggccgtcctagtgtccgatggctcctatacattcaccctcttcaattattacgaaatcaactggaccacggggacggcgagtggcggcgaccccctgacaggtcttggtggagtgatggcacaggcaggatttaatggtggaaacctcaccaatttcttcagcctcccggggtcaagaacccccgagatcgtgaatatccaggagaccacaaacgtcaatgttccaggccgctgggcatttaaagttgatggaaaggaaattgacccagccaatggctgcacctcaaggggacaattccttcggcgaggggaggtgttttgggatgacttgaactgcaccgtcaagtgccgctgtctggatttcaacaatgagatctactgccaggaggcttcctgtagcccctacgaggtgtgcgaacccaaaggcaaattcttctactgcagcgctgtggagaccagcacatgcgtggtgtttggggagccacactaccacacttttgacggcttcctcttccacttccaaggctcctgtgcctacttgctggcccgacagtgtttgcagacttccagcctccctttcttcagtgtggaggccaagaatgaacaccgcagaggttcagccgtctcctgggtgaaggagctctcagtggaggtgaatggctacaagattctcatccccaaaggaagctatggaagagtcaaggttaatgacctagtgacttctttgcctgtcaccttagacttggggacagtgaaaatctaccagagtggcatatctactgccgtggaaacagattttgggctcttagtgacttttgatggccagcactacgcctccatttccgtcccaggctcctatataaactccacctgtggactctgtggaaactataataaaaacccactggatgacttcctccgcccggatggcaggccggccatgtctgtcctggatctgggagagagctggcgtgtgtaccacgcagactggaagtgcgactccggctgcgtcgacaactgcacccagtgcgacgctgccactgaagccctctactttggctctgactactgcggcttcctcaacaagacagacggccctctgtgggagtgtggcactgtcgtggaccccactgcttttgtgcacagctgcgtgtatgacctgtgcagtgtgagggacaatggcacgctcctctgccaagccatccaggcctatgctcttgtgtgccaagcccttggcattccaattggagactggcgaacccagactgggtgtgtgtccacagtgcagtgcccgagcttcagccactactccgtgtgcacaagcagctgccccgacacatgctccgacctgacggcctcgcggaactgcgccacgccgtgcacagagggctgcgagtgcaaccagggcttcgtcctcagcaccagccagtgcgtccctctgcacaagtgcggctgcgacttcgacggccactactacaccatgggggagttcttctgggccacggccaactgcactgtgcaatgcctgtgcgaggagggcggggacgtctactgcttcaacaagacctgcggcagcggggaggtgtgcgccgtggaggacggctaccagggctgcttccccaagcgggagaccgtgtgcctgctcagccagaaccaggtgctgcacacctttgacggcgcctcctacgccttcccctccgagttctcctacaccctcctgaagacctgccctgagcgcccagagtacttggaaatcgacatcaacaagaagaagcccgatgcaggacctgcttggctgcggggacttcggatcctggtggccgaccaggaggtcaagataggaggcatcggggcttcggaagtcaagttgaatggtcaggaagtggaattgccttttttccatccttcggggaagctggaaatttatcgaaacaaaaacagtacgacagtggagtccaagggcgtggtgactgtccagtactcagacataggtctattgtacatccggctgtccaccacatacttcaattgcacagggggcttgtgcggcttctacaatgccaacgccagtgacgagttctgtctccccaacggcaagtgcacggacaacctggcagtgttcctggaaagctggacaactttcgaggagatctgcaatggagagtgtggggacctgctgaaggcctgcaacaatgactcggagctgctcaagttttatcgaagccgctccaggtgcggcatcatcaacgacccctccaacagctccttcctggagtgccatggggtggtgaacgtcactgcctattaccgcacctgccttttccgcctgtgccagagtgggggcaatgagtcagagctctgtgactctgtggcccggtatgcaagcgcctgcaagaatgcggacgtggaggtggggccctggcggacctatgacttctgcccactggagtgcccagagaacagccactttgaggagtgcatcacatgtacagagacctgtgagacccttaccctgggccccatctgcgtggatagctgctctgagggatgtcagtgtgatgagggctatgctctactgggcagccagtgtgtcacgcggagtgagtgtggctgcaactttgaggggcaccaacttgccaccaatgagaccttctgggtggacctggactgccagatcttctgctattgcagtggcacagacaacagggtccactgcgagaccattccctgcaaggatgatgagtactgcatggaggaaggtggcctgtactactgccaagcccgcaccgacgcctcctgcatcgtctcaggctacggccactacctcacctttgatggcttcccctttgacttccagaccagctgcccactcatcctgtgcaccacaggaagcaggccaagctcagactctttccccaagtttgttgtcacagccaagaatgaggaccgggacccgtcactggccttgtgggttaagcaggtggacgtgaccgtgtttggctacagcatcgtgatccaccgagcttacaagcacactgtgctggtcaacagtgaacggctctatctgcccctgaagctggggcaagggaagataaatatcttttcctttggcttccacgtggtggtggaaactgattttggcctgaaggttgtatatgactggaagaccttcctgtccatcacagtccctcggagcatgcagaacagcacctatggtctgtgtggccgctacaacggcaaccctgatgatgacctggagatgcccatgggtctgcttgcatcgagtgtcaatgagtttgggcagagctgggtgaagagggacaccttctgccaggtgggctgtggggaccgctgtccgtcctgtgccaaggtggaaggtttctccaaagtgcagcagctgtgcagcctgatccccaaccagaacgctgccttctccaagtgtcacagcaaagttaaccccaccttcttctataagaactgcctgtttgactcttgcatcgatgggggcgcggtgcagaccgcctgcagctggctgcagaactacgccagcacctgccagactcaggggattacggtgactggctggaggaattacacgtcctgcactgtcacctgccctccaaacagccattacgagagctgcgtgagtgtctgccagccccgctgcgccgccatccgcctgaagagtgactgcagccactactgcgtggagggctgtcactgcgacgctggctacgtcctcaacggcaagagctgcatcctgccccacagctgcggctgctactccgatggcaaatattacgagcccaagcagctattttggaacagcgactgcacgcggcgctgccgctgtttccgtcgcaacgtgattcagtgcgacccgcgccaatgcaagtcagacgaggagtgtgcgctgcgcaacggggtgcgcggctgcttcagcaccaagacctcctactgcctggcggccggcggcggcgtcttccgcaccttcgacggcgccttcctgcgcttcccagccaactgcgccttcgtgctgtccaccatctgccagaaactgcccgacatctccttccagcttatcatcaacttcgacaagtggtcggcccccaacctcaccatcatttcgcccgtctacttctacattaacgaagagcagattctcatcaacgaccggaacacggtcaaggtgaatggcacacaagtgaatgttccatttataactggtttggcaaccaaaatctacagcagtgaggggtttctggtgattgacaccagcccagacatccagatatactacaatggtttcaacgtcattaaaatcagcatcagcgagaggctgcagaacaaagtgtgcggtctctgtggcaacttcaacggggacctaacagatgattatgtgaccttgcgagggaagccggtggtaagcagcgtggtgctggcccagagctggaaaaccaatggcatgcagaagagacctcttgcccccagctgcaacgagctgcagttctcacagtatgcagccatgtgtgacaatgtgcacatccagaagatgcagggtgatggctactgcctgaagctcaccgacatgaagggcttcttccagccctgctatgggcttctcgatcccctcccattctacgagtcctgctacctggacggctgctacagccacaagaagttccagctgtgcggctccctggccgcctacggggaggcctgccgctccttcgggatccttagcaccgagtggattgagaaggagaattgctcaggagtggttgaagatccctgtgtgggggcggactgtcccaaccgaacttgcgagctgggcaatggcagggagctgtgtggctgcatcgagccacccccctatggaaataactcacatgacattatcgatgcagaggtgacctgcaaagcagcccaaatggaagtgtccatatctaagtgcaagctcttccagctcggttttgagagggagggcgtgaggatcaatgacagacagtgcaccggcatcgagggggaagattttatctcctttcagatcaacaacaccaaagggaattgtggaaacattgtgcagtccaatggcacgcatatcatgtataaaaacacactctggatcgaaagcgccaacaacactggcaacatcatcaccagggaccgcacgatcaatgtggaattttcatgtgcttatgagctggatatcaagatctccttggattctgttgtgaagcctatgctaagtgtaattaacctgacagttccaacccaagaaggcagcttcatcaccaagatggctctctacaaaaacgcctcctacaaacatccttaccgccagggtgaagtagtgttgacgactcgagatgtgctgtatgtaggggtttttgtggttggagctgacgccacacatttaatcctaacactcaacaaatgctatgccacacccacccgagatagcaatgataagctccgatatttcatcattgaaggagggtgtcagaacctcaaagataacaccattggcatcgaggagaatgcagtctccctgacctgtcgctttcacgtcaccgtctttaaattcataggggattacgacgaagttcaccttcactgtgcagtgtcactctgcgactcagaaaagtactcctgtaaaatcacttgcccacacaattccaggattgccacagattacacaaaagagcccaaagaacagatcatttcagtgggacctattaggagaaaaaggctggactggtgtgaggacaatggagggtgtgagcagatttgcacgagccgggtggatgggcctctctgcagctgtgtaacaggaaccctgcaggaggacggcaagagctgcagagcctctaattcttcaatggaacttcaagtctggacgcttcttctcatcatgatccagatttcattatggcattttgtctataaatcaggcacgacctcataattaactcaaggttgctatataaagtactgtaatttacttacttcaacaccctgtaggataaaaagtgtgtgcccttaagtcaaaacctatttgaaagtgtccagcatctcaaaatgatgccacctgcctccaatggtccaaggtccagaaaccagcgaccatccaagctcctctttcagagtatgaaacggggcttctacaagccagttatggaaagtatctctcttgtgtaaaattcccaaacagttgtcactagagactttggttcacatgaaaaaccagtaaaggaaaaaaattctggttagagaaatctgactggaaatctgaccagagaaatctgtcaagccagtgctatttctggatcacagttttttacagagagagggcctgttggaacgattttgaagtgatgactggaaggtttgactccctctaaggaatcttgctggtgtttggaagtgtccgatctacgttatgcacgtgttctgtctatgaggcgcttctccacccactgtgtccttcaaccttgccatggcagctttggccactggggatattgttgacctggggaaccccacccactctcctaccccctcgaacccaatcccttctctttttacaaatcaaccaaatactttttaatgtgttttatccttaaataaactttgtgttcaagtattctcatta

SEQ ID NO: 189976 - DNA, 2713 bp, Homo sapiens
  Payload ID: 17513
  Gene Symbol: TECTB
  Gene Name: tectorin beta
  Uniprot ID: Q96PL2
  ENST ID: ENST00000369422
  CDS Start-End: 1-990
atggtgacgaaggcctttgtcttgttggccatctttgcagaagcctctgcaaaatcgtgtgctccaaataaagcagatgtcattcttgtgttttgctatcccaaaaccatcatcaccaaaatccccgagtgtccctatggatgggaagttcatcagctggccctcggagggctgtgttacaatggggtccacgaaggaggttactaccaatttgtgatcccagatttatcacctaaaaacaagtcctattgtggaacccagtctgagtacaagccacctatctatcacttctacagtcacatcgtttccaatgacaccacagtgattgtaaaaaaccagcctgtcaactactccttctcctgcacctaccactccacctacttggtgaaccaggctgcctttgaccagagagtggccactgttcacgtgaagaacgggagcatgggcacatttgagagccaactgtctctcaacttctacactaatgccaagttctccatcaagaaagaagctccctttgtcctggaggcatccgaaatcggttcagatctgtttgcaggagtggaagccaaagggttaagcattaggtttaaagtggtcttgaacagctgttgggccaccccctcggctgacttcatgtatcccttgcagtggcagctgatcaacaagggctgccccacggatgaaaccgtcctcgtgcatgagaatgggagagatcacagggcaaccttccaattcaatgctttccggttccagaacatccccaaactctccaaggtgtggttacactgtgagacgttcatctgcgacagtgagaaactctcctgcccagtgacctgcgataaacggaagcgcctcctgcgagaccagaccgggggagtcctggtcgtggagctctccctgcggagcaggggattttccagtctctatagcttctcagatgttctccaccacctcatcatgatgttggggatttgtgccgtgttataggagttagccaggcagctgccgctcctccacccacaatagtcctcagcgaatgacaaacacatttattgtgctgccaaaaagaacaaacagaagaccacattgttggggggcagagaatagcactttgccaaatatgcactccaataatttctgtgaatttggtgatgcctttttctttctaagaaaaacttaggctacttcccgtggcccttagatctcacagtccttctacagctgggggaggagcctcctttctccatactcaagtcagggctgcagtaaattcctttgaaagctattttaactttaaaaggttagcagacccaaccaagtactgctgagcattttgaagagaatgtagggtgcaactacaaagtcaacactaaatgcacaacgcacattaatagctgactttgccaaaaaggagctttgtcattgaggcagtgtcattctacttaaggaccagagctgagcccccacgcagggagttccaatctttcaactgatgacatgggagatgatgtgggattcagagtggaatacaatagttttgctcaaacctaatgatataaaggaaatagattcttgaaagcccctagtactgacctaatttgtttttattataccatttgttaaatatataaacatgatataggtagaaactccttgtttttatagcagatgtatacttctaaagtcaaaagaaaattacaaattaaataggaatatttacaaaaagaataatcacaagaagaatacaactcacattaatttaacctaataacacggcattgccccagtgaaactgctgctggaaacatgactataaagtgactccaatgacacaagtgctgtgagtttggtgacccaatcctacagataaatgccttgtgacactcaatgctattttttctctatttgctctactaagaagttttcatttataagaaatggtctgatctcatttagcttttacttaaacatcgaagcttacatctgtttttgtctcattcacttacaatcattagaatgaagctaacacaaaatcagaaacacaaatgcaaatgcagccaatgaaagcatgcagtagcacatcttggtaactggccaccccagtgatccagaatatgcccatataaatgatttacattgtcaacaaaatacaaactgaatgaaccaattctggtagagaattggctggattgtgataggaaaaggcagagttctaagtccttagttatgtaaagacttaattagtaggcttataatttgaaaacaacacatgggtttgtctctctgtatttaaggtatttgagaagttttgcaatttgcagtttgatgattcttttacaacttgtgttagtgaactcagagattaaactagttatgaaatctccggatacatgaagtgtatgtttgtttagtaataggctaaagtaaaatgactcaatttggtctagacttggtctctaagctggagttccaacgagtttaggatctcttctttctgtaaattcagagtttttatagtcaggaaaaacagaagacatattttattggttctagtagaaaactcttaaatagcatactcatagccatgttcaaatcctttgctgtcagaataaaccaatgttgtattagttttgctgtatttcatcattgtgttttatgatcttgtatctctacctggcgctatggaataaataaaatgccttaaaataaa

SEQ ID NO: 189977 - DNA, 4760 bp, Homo sapiens
  Payload ID: 17514
  Gene Symbol: TEK
  Gene Name: TEK tyrosine kinase, endothelial
  Uniprot ID: Q02763
  ENST ID: ENST00000380036
  CDS Start-End: 443-3817
agtttcccgcctatgagaggatacccctattgtttctgaaaatgctgaccgggacccacacttccaacaaaaattcctctgcccctacagcagcagcaaaagcagcagcagaagcaacagcaacagataagtgttttgatgaattgcgagatggatagggcttgagtgcccccagccctgctgataccaaatgcctttaagatacagcctttcccatcctaatctacaaaggaaacaggaaaaaggaacttaaaactccctgtgctcagacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaagcatgccaccctggtttttacgggccagattgtaagcttaggtgcagctgcaacaatggggagatgtgtgatcgcttccaaggatgtctctgctctccaggatggcaggggctccagtgtgagagagaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcagctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtatgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattctaacaagtcataggttaatatttaagacactgaaaaatctaagtgatataaatcagattcttctctctcaattttatccctcacctgtagcagccagtcccgtttcatttagtcatgtgaccactctgtcttgtgtttccacagcctgcaagtcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactcacgtctcat

SEQ ID NO: 189978 - DNA, 3935 bp, Homo sapiens
  Payload ID: 17514
  Gene Symbol: TEK
  Gene Name: TEK tyrosine kinase, endothelial
  Uniprot ID: Q02763
  ENST ID: ENST00000406359
  CDS Start-End: 176-3421
agacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcagctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtatgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattctaacaagtcataggttaatatttaagacactgaaaaatctaagtgatataaatcagattc

SEQ ID NO: 189979 - DNA, 1543 bp, Homo sapiens
  Payload ID: 17514
  Gene Symbol: TEK
  Gene Name: TEK tyrosine kinase, endothelial
  ENST ID: ENST00000519080
  CDS Start-End: 139-1543
gttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctgtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcagctgtgatttctt

SEQ ID NO: 189980 - DNA, 3836 bp, Homo sapiens
  Payload ID: 17514
  Gene Symbol: TEK
  Gene Name: TEK tyrosine kinase, endothelial
  Uniprot ID: Q02763
  ENST ID: ENST00000519097
  CDS Start-End: 451-3381
ttattctcagtttcccgcctatgagaggatacccctattgtttctgaaaatgctgaccgggacccacacttccaacaaaaattcctctgcccctacagcagcagcaaaagcagcagcagaagcaacagcaacagataagtgttttgatgaattgcgagatggatagggcttgagtgcccccagccctgctgataccaaatgcctttaagatacagcctttcccatcctaatctacaaaggaaacaggaaaaaggaacttaaaactccctgtgctcagacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctgcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcagctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtatgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattct

SEQ ID NO: 189981 - DNA, 4666 bp, Homo sapiens
  Payload ID: 17514
  Gene Symbol: TEK
  Gene Name: TEK tyrosine kinase, endothelial
  ENST ID: ENST00000615002
  CDS Start-End: 443-1849
agtttcccgcctatgagaggatacccctattgtttctgaaaatgctgaccgggacccacacttccaacaaaaattcctctgcccctacagcagcagcaaaagcagcagcagaagcaacagcaacagataagtgttttgatgaattgcgagatggatagggcttgagtgcccccagccctgctgataccaaatgcctttaagatacagcctttcccatcctaatctacaaaggaaacaggaaaaaggaacttaaaactccctgtgctcagacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaagcttccttcctaccagctactttaactatgactgtggacaagggagataacgtgaacatatctttcaaaaaggtattgattaaagaagaagatgcagtgatttacaaaaatggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagatgtgaagcccagaagtggggacctgaatgcaaccatctctgtactgcttgtatgaacaatggtgtctgccatgaagatactggagaatgcatttgccctcctgggtttatgggaaggacgtgtgagaaggcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggcatacagaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatccaaaagactttaaccatacggatcatttctcagtagccatattcaccatccaccggatcctcccccctgactcaggagtttgggtctgcagtgtgaacacagtggctgggatggtggaaaagcccttcaacatttctgttaaagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaagtatccatggagaaacagaggctgactaaagcaaatagtgacaaatgagattgttacactcaactatttggaacctcggacagaatatgaactctgtgtgcaactggtccgtcgtggagagggtggggaagggcatcctggacctgtgagacgcttcacaacagcttctatcggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacattcttcctcctcaaccagaaaacatcaagatttccaacattacacactcctcagctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaagcaccagcggacctcggaggggggaagatgctgcttatagccatccttggctctgctggaatgacctgcctgactgtgctgttggcctttctgatcatattgcaattgaagagggcaaatgtgcaaaggagaatggcccaagccttccaaaacgtgagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaagaatatgcctccaaagatgatcacagggactttgcaggagaactggaagttctttgtaaacttggacaccatccaaacatcatcaatctcttaggagcatgtgaacatcgaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacagtttatccacagggatctggctgccagaaacattttagttggtgaaaactatgtggcaaaaatagcagattttggattgtcccgaggtcaagaggtgtatgtgaaaaagacaatgggaaggctcccagtgcgctggatggccatcgagtcactgaattacagtgtgtacacaaccaacagtgatgtatggtcctatggtgtgttactatgggagattgttagcttaggaggcacaccctactgcgggatgacttgtgcagaactctacgagaagctgccccagggctacagactggagaagcccctgaactgtgatgatgaggtgtatgatctaatgagacaatgctggcgggagaagccttatgagaggccatcatttgcccagatattggtgtccttaaacagaatgttagaggagcgaaagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattctaacaagtcataggttaatatttaagacactgaaaaatctaagtgatataaatcagattcttctctctcaattttatccctcacctgtagcagccagtcccgtttcatttagtcatgtgaccactctgtcttgtgtttccacagcctgcaagtcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactcacgtctc

SEQ ID NO: 189982 - DNA, 3421 bp, Homo sapiens
  Payload ID: 17515
  Gene Symbol: TEKT1
  Gene Name: tektin 1
  Uniprot ID: Q969V4
  ENST ID: ENST00000338694
  CDS Start-End: 131-1387
gttgtcatggagaccgcgttgtttacctctctgttctgcaagagctggaagctccagttggggtaaggaggctcccatcccgagcttgcgtagtggttctgtgtggcgctgaggaatttggaaacctcaaatggctaaactattacaacctccacccaagttcctgccctcagagtggcacattgctaacaagaaccagtaccacagagcagacgctcaaaggtcccgatcagaacgcctggtcgcagaaagccagaggcttgtggatgaaattgaaaagaccacaagaaaatctcaaagcgatgtgaacaagaaactagaacagagactcgaggaagtccagttctggaagaaggagttagatgacaaacttgagcagcttgtgaatgtaactgatgatctactcatatataagatcagattggaaaaagccctggagaccttgaaagagcccttgcacatcactgagacatgcctggcatacagggagaagcgcattggcattgacctggtgcacgacacagtggagcatgagctgataaaggaggctgagatcatccagggcattatggctctgctgacccgtaccttggaggaggcttccgagcagattcggatgaaccgctctgccaagtacaatcttgagaaggatttgaaggacaagtttgtggccctgaccatagatgatatctgcttctcgctcaacaacaactcaccaaacatcagatattctgagaacgccgtgaggattgagccaaactccgtgagtctggaagactggttggacttctccagcaccaatgtggagaaggctgacaagcagcggaacaactccctgatgctgaaagccctggtggatcgaatcctgtcccagacagccaatgatctgcgcaagcagtgtgatgtggtggacacggcattcaagaatgggctgaaggatacaaaggatgccagggacaagctggctgatcatctggccaaggtcatggaagagattgcttcccaggagaaaaatattacagctcttgaaaaggccatccttgaccaagaagggccagccaaggtggctcatacgcgcttggagaccaggacacaccggccgaacgtggagctgtgtcgtgatgtcgcacaatataggctaatgaaggaggttcaagagatcacccacaatgtcgcaagattgaaggaaactttagcccaagctcaggcagagctgaaagggctgcatcgcagacagcttgccctgcaggaggagatccaggtcaaagagaacaccatttatatcgacgaagtgctgtgtatgcagatgaggaaatccatcccacttcgggatggggaagaccatggggtctgggctgggggcctccgccctgatgctgtctgctaatagtagggctagttccaattctcattaaaccacattgtaaacagtagttacagtagtacagagctctcatttcaggctggcggggcctctagccagcctgctgcaacctcttggctggcattccaagcctgctcagggggctgattttggggcgagtttcttctcttatgctggtgtggtgtttgcctaacaattcaactccatattttagcacaggccactcttacaatatcacaggacttggggccccaggacagggtttcaagacatttcagttcagattcaattcaataaagtagttgggctggatcacctgtgtagaccatgcccctcttgctcatgagatgggatgctaacctttctcttggctctcaaaatttcttttctctagaaaataatgtgttttttttctcttaaatactcaaataacataaagaaaaagaacaaaattccattcattcaagtcaatgggttcaagtcaatggttaagactgtaggttccggagtctgccatctgagtataggacctccaatagtccccactcacagggctataggggcgttgaatgagatcacctccgtaaagggcttcatactgagcctgtatcatggggcagtgagtgtttaatgaatgtgagccattgtgagcagtcccaccctataccaacataatttctgcacaattgtactcatggcataaactcaatttcaggattatttttttccttcactgctaattattgcaagcctttgttcatgttgctaaattgtctttataattattttaatggttacgtacctctttacaagttttcagcaagactgttttatatacttactgtttcttttccaaaaagagttcaacttgtgggaggctgccttccgctgagctgcagcaggtcagagatctatgtgggtgactgtcaaaggaagacatttgctgtgggaaactgctcatttgttccttattccgctaacattgaaggaacactttccatggacgaggcttaccatctcagcaccctcccatgtgtgaagctgctgctacactctgctaacatttggttccccggtgctcatggacagctgacggtgtggggctcaggagacctagcttctagttgcaacactgccaggaaagtttctctccttctttaggaccacctgtaaagtaaggaaaggactatatcgtctggaactcttcctgtccttgctgttccctgaatctggctgtctagctgcacatacggtgtcatagggcacaatgataatgcagagtgtgggcctaattcctgggagctttgcaatctaggtgctccttggtccagagactctttgccatcagaaagggatgttcccaatctgggatggagaaaccccctttgaggccaaaagcactggcttaattctgttaattctgatctatgccaccccagtgctgaacgtctcctctcagagtgctcagcaaatacacagcccttcccatgcctcaatcaaggagggaggcccctctctgctcactgggaagcctctgggtgcttttctgctctggctcggaagagtccaaataagccttcccagctcactgggcagacctcagagtttctgctaacttagcagggttttgaggtctgtcccagaggatgtggctggcagggtgtgaagacactgggcaaaatccttccttgtgaatacagctctcagaggcagccagcctcagtggtggattcagatcccaggctctgcagggagatgtgattcagatcagctggtggatcagctccacgctctacctgtgatgtgatccccgccaagttactcaacttccccgagcttcagttgcctaatctgtaaataagactaataaagcctagattggcgagataacgtgtggaagactctcaacacagtgtctggaacatgctgcttttaagggaaatgtgattttgattatggttgaggccatttctcaacatgtagacataaaatgcggaaacatctaagatttcaataaagcaatgttttgttagtaaa

SEQ ID NO: 189983 - DNA, 492 bp, Homo sapiens
  Payload ID: 17515
  Gene Symbol: TEKT1
  Gene Name: tektin 1
  ENST ID: ENST00000572291
  CDS Start-End: 1-433
gaggattgagccaaactccgtgagtctggaagactggttggacttctccagcaccaatgtggagaaggctgacaagcagcggaacaactccctgatgctgaaagccctggtggatcgaatcctgtcccagacagccaatgatctgcgcaagcagtgtgatgtggtggacacggcattcaagaatgggctgaaggatacaaaggatgccagggacaagctggctgatcatctggccaagattgaaggaaactttagcccaagctcaggcagagctgaaagggctgcatcgcagacagcttgccctgcaggaggagatccaggtcaaagagaacaccatttatatcgacgaagtgctgtgtatgcagatgaggaaatccatcccacttcgggatggggaagaccatggggtctgggctgggggcctccgccctgatgctgtctgctaatagtagggctagttccaattctcattaaaccacattgtaaacagta

SEQ ID NO: 189984 - DNA, 384 bp, Homo sapiens
  Payload ID: 17515
  Gene Symbol: TEKT1
  Gene Name: tektin 1
  ENST ID: ENST00000571744
  CDS Start-End: 1-195
accaatgtggagaaggctgacaagcagcggaacaactccctgatgctgaaagccctggtggatcgaatcctgtcccagacagccaatgatctgcgcaagcagtgtgatgtggtggacacggcattcaagaatgggctgaaggatacaaaggatgccagggacaagctggctgatcatctggccaagagaagctgaaactcaaggaggttaaattcttgccccaaggcacaagacaagttcatggcaggccagtactcatccagacacctggctccaaaagccaggtttggggccatcaaacttggccattcacatctatgttcaacatcacagacccggtctcagcatatttgtggaaaaataaaggagacacaggaaaaacgg

SEQ ID NO: 189985 - DNA, 1587 bp, Homo sapiens
  Payload ID: 17515
  Gene Symbol: TEKT1
  Gene Name: tektin 1
  ENST ID: ENST00000575592
  CDS Start-End: 131-373
gttgtcatggagaccgcgttgtttacctctctgttctgcaagagctggaagctccagttggggtaaggaggctcccatcccgagcttgcgtagtggttctgtgtggcgctgaggaatttggaaacctcaaatggctaaactattacaacctccacccaagttcctgccctcagagtggcacattgctaacaagaaccagtaccacagagcagacgctcaaaggtcccgatcagaacgcctggtcgcagaaagccagaggcttgtggatgaaattgaaaagaccacaagaaaatctcaaagcgatgtgaacaagaaactagggagaagcgcattggcattgacctggtgcacgacacagtggagcatgagctgataaaggaggctgagatcatccagggcattatggctctgctgacccgtaccttggaggaggcttccgagcagattcggatgaaccgctctgccaagtacaatcttgagaaggatttgaaggacaagtttgtggccctgaccatagatgatatctgcttctcgctcaacaacaactcaccaaacatcagatattctgagaacgccgtgaggattgagccaaactccgtgagtctggaagactggttggacttctccagcaccaatgtggagaaggctgacaagcagcggaacaactccctgatgctgaaagccctggtggatcgaatcctgtcccagacagccaatgatctgcgcaagcagtgtgatgtggtggacacggcattcaagaatgggctgaaggatacaaaggatgccagggacaagctggctgatcatctggccaaggtcatggaagagattgcttcccaggagaaaaatattacagctcttgaaaaggccatccttgaccaagaagggccagccaaggtggctcatacgcgcttggagaccaggacacaccggccgaacgtggagctgtgtcgtgatgtcgcacaatataggctaatgaaggaggttcaagagatcacccacaatgtcgcaagattgaaggaaactttagcccaagctcaggcagagctgaaagggctgcatcgcagacagcttgccctgcaggaggagatccaggtcaaagagaacaccatttatatcgacgaagtgctgtgtatgcagatgaggaaatccatcccacttcgggatggggaagaccatggggtctgggctgggggcctccgccctgatgctgtctgctaatagtagggctagttccaattctcattaaaccacattgtaaacagtagttacagtagtacagagctctcatttcaggctggcggggcctctagccagcctgctgcaacctcttggctggcattccaagcctgctcagggggctgattttggggcgagtttcttctcttatgctggtgtggtgtttgcctaacaattcaactccatattttagcacaggccactcttacaatatcacaggacttggggccccaggacagggtttcaagacatttcagttcagattcaattcaataaagtagttgggctggatcacctgtgtagaccatgcccctcttgctcatgagatgggatgctaacctttctctt

SEQ ID NO: 189986 - DNA, 1509 bp, Homo sapiens
  Payload ID: 17516
  Gene Symbol: TEKT2
  Gene Name: tektin 2 (testicular)
  Uniprot ID: Q9UIF3
  ENST ID: ENST00000207457
  CDS Start-End: 128-1420
tggttgcctagcaaccggtggtgccaaacactggagctcagagcggggggcgcggagagcgaagcgggaaaggaggtggtgtctgtgaacaggcctaggggtttctgacccttctggtttctgtgccatggccacgctgagcgtcaagccaagtcggcgcttccagctgcccgactggcacactaacagctacctgctatccaccaatgcccagctgcagcgagatgcttcccatcagatccgccaggaggcccgggtgctccgcaacgagaccaacaaccagaccatttgggatgaacatgacaacaggactcgactggtggagaggattgatactgtcaaccggtggaaggagatgctggacaagtgtctgacagatttagatgccgagatcgatgccctgacacagatgaaggagtcagcagagcaaaacctgcaggccaagaacctgcctctggatgtggccattgagtgcctgaccctgcgggaaagccggcgagacattgatgtggtgaaggaccctgtggaggatgagctgcataaagaggtggaggtcatcgaggccaccaagaaggccttgcaacagaaggtcagccaggccttcgagcagctctgcctcttgcaggaagtccaacagcagctcaactccgaccatcggggcaaaatggagacactagagatcgacagaggctgtctctctctcaacctcagatccccaaacatctcgctgaaggttgaccccacacgtgtacctgatggctccaccacactccagcagtgggatgacttcagtcggttcaacaaggaccgagcggaggctgagatgaaggcagccacagagctgagggaggccactgctctaactattgctgagaccaacaacgagcttgaagcccagagagttgcaacggaatttgccttcaggaagcggctgcgggagatggagaaagtgtacagtgagctcaagtggcaagagaagaataccttggaggagatcgctgagctgcaggaggacatccggcacctggaggaggatctgcgcacaaagctcctgagcctgaagctgtcccatacccggctagaggccagaacctaccggcccaacgtggaactctgccgggaccaggcacagtacggcctcaccgacgaggttcaccagctagaggcaaccatcgctgccctgaagcagaagctggcgcaagcacaggacgcactggacgccctgtgcaagcacctggcccggctgcaggctgacattgcctgcaaggccaactccatgctgctggacaccaagtgcatggacacacggcgcaagctgaccgtgcctgctgagaggttcgtgcctgaggtggacaccttcacacgtaccacaaatagcaccctgagtccactcaaaagctgccagctggagctggcctagccttggaggactgcaggaggagggcagggttgggtgggcaatggaaggagggaggagagaaatgaatggaataaatgcagaggatctca

SEQ ID NO: 189987 - DNA, 753 bp, Homo sapiens
  Payload ID: 17516
  Gene Symbol: TEKT2
  Gene Name: tektin 2 (testicular)
  ENST ID: ENST00000473120
  CDS Start-End: 1-289
caggaagcggctgcgggagatggagaaagtgtacagtgagctcaagtggcaagagaagaataccttggaggagatcgctgagctgcaggaggacatccggcacctggaggaggatctgcgcacaaagctcctgagcctgaagctgtcccatacccggctagaggccagaacctaccggcccaacgtggaactctgccgggaccaggcacagtacggcctcaccgacgaggttcaccagctagaggcaaccatcgctgccctgaagcagaagctggcgcaagcacagtaggtctcgggagtgggcggaaggagcagtgagacgctgcccacaaatggggcctcttgctggctgctggctccctggggctgtcttcctgactgaaggctatgcacgcagcccaggcctcccagcctcatgggggctggggggttgtcaatgtccttccctagggacgcactggacgccctgtgcaagcacctggcccggctgcaggctgacattgcctgcaaggccaactccatgctgctggacaccaagtgcatggacacacggcgcaagctgaccgtgcctgctgagaggttcgtgcctgaggtggacaccttcacacgtaccacaaatagcaccctgagtccactcaaaagctgccagctggagctggcctagccttggaggactgcaggaggagggcagggttgggtgggcaatggaaggagggaggagagaaatgaatggaataaatgcagaggatctca

SEQ ID NO: 189988 - DNA, 1738 bp, Homo sapiens
  Payload ID: 17516
  Gene Symbol: TEKT2
  Gene Name: tektin 2 (testicular)
  ENST ID: ENST00000469024
  CDS Start-End: 226-552
gcgggagggcgtggcggctaccagacggggagggggccgccccgggggccgccccccagctccccagtgccaacaggcacgcgtccctggagacagaacagggctcctgcccttagatcccccacggggactggcccgcagcctggggaagaaaggaaaggaagatcaacaaggtggtgtctgtgaacaggcctaggggtttctgacccttctggtttctgtgccatggccacgctgagcgtcaagccaagtcggcgcttccagctgcccgactggcacactaacagctacctgctatccaccaatgcccagctgcagcgagatgcttcccatcagatccgccaggaggcccgggtgctccgcaacgagaccaacaaccagaccatttgggatgaacatgacaacaggactcgactggtggagaggattgatactgtcaaccggtggaaggagatgctggacaagtgtctgacagatttagatgccgagatcgatgccctgacacagagacggggtttcaccattttggccaggctgttctcgaactcctgacctcaagtgttccatccaactcggcctcccgaagtgctgggattacagatgtgagccaccgtgcccggccgcgccctcttttctagatgaaggagtcagcagagcaaaacctgcaggccaagaacctgcctctggatgtggccattgagtgcctgaccctgcgggaaagccggcgagacattgatgtggtgaaggaccctgtggaggatgagctgcataaagaggtggaggtcatcgaggccaccaagaaggccttgcaacagaaggtcagccaggccttcgagcagctctgcctcttgcaggaagtccaacagcagctcaactccgaccatcggggcaaaatggagacactagagatcgacagaggctgtctctctctcaacctcagatccccaaacatctcgctgaaggttgaccccacacgtgtacctgatggctccaccacactccagcagtgggatgacttcagtcggttcaacaaggaccgagcggaggctgagatgaaggcagccacagagctgagggaggccactgctctaactattgctgagaccaacaacgagcttgaagcccagagagttgcaacggaatttgccttcaggaagcggctgcgggagatggagaaagtgtacagtgagctcaagtggcaagagaagaataccttggaggagatcgctgagctgcaggaggacatccggcacctggaggaggatctgcgcacaaagctcctgagcctgaagctgtcccatacccggctagaggccagaacctaccggcccaacgtggaactctgccgggaccaggcacagtacggcctcaccgacgaggttcaccagctagaggcaaccatcgctgccctgaagcagaagctggcgcaagcacaggacgcactggacgccctgtgcaagcacctggcccggctgcaggctgacattgcctgcaaggccaactccatgctgctggacaccaagtgcatggacacacggcgcaagctgaccgtgcctgctgagaggttcgtgcctgaggtggacaccttcacacgtaccacaaatagcaccctgagtccactcaaaagctgccagctggagctggcctagccttggaggactgcaggaggagggcagggttgggtgggcaatggaaggagggaggagagaaatgaatggaataaatgcagaggatctca

SEQ ID NO: 189989 - DNA, 1630 bp, Homo sapiens
  Payload ID: 17517
  Gene Symbol: TEKT3
  Gene Name: tektin 3
  Uniprot ID: Q9BXF9
  ENST ID: ENST00000338696
  CDS Start-End: 36-1508
taacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggagaacgtgtcaatgacatagggttttggaaatctgaaatcattcatgagttggatgaaatgattggagagacaaatgcacttactgatgtgaagaaaagactggagcgggctttgatggagactgaagcccctcttcaggtagcccgagaatgtctatttcatcgagaaaagagaatgggaatcgacctagttcacgatgaagttgaagcacaactgctgacggaagttgatactattctgtgttgtcaagaaagaatgaagctacatttggataaggctattgcccaacttgcagccaacagagcgtcccagcatgagctggaaaaggacctgagtgacaaacagacggcttaccggatcgacgacaaatgccaccacctgcgcaacacatcagacggtgtcggctacttccgcggagtggagagggtcgatgcaactgtctcagtgcctgagtcctgggccaaatttacagatgacaatattctccgctcccagagtgaacgggcagcttccgctaagctaagagacgacattgaaaacctcttggttgtgactgccaatgagatgtggaatcaattcaacaaagtgaacttgtctttcaccaatcgcattgctgagactgcagatgctaagaataagattcagacgcacttagcaaagaccctgcaggagattttccagactgaaatgaccatagaatccatcaagaaggccatcaaggacaagactgccttcctgaaggtggctcagaccagactggatgagcgcacaagacggccgaacattgagttgtgccgagacatggctcagctacgccttgttaacgaggtacacgaggttgacgacaccatccagaccctgcagcagcgcctgagggatgcagaggacaccctgcagtcgctggtccacatcaaagccacactcgagtatgacctggctgtcaaagccaattccctgtacatcgaccaggaaaaatgcatgagcatgcgcaagagctaccccaacaccctccggctggtcggcttctgctagggaccccaccgggtgtggttttgatacccctaagttaaggctgagccagagcactgtctcagcatttgaaccgaatgctaatatagtcacttattaaaggattatgctgatggaaatgtacc

SEQ ID NO: 189990 - DNA, 1785 bp, Homo sapiens
  Payload ID: 17517
  Gene Symbol: TEKT3
  Gene Name: tektin 3
  Uniprot ID: Q9BXF9
  ENST ID: ENST00000395930
  CDS Start-End: 188-1660
acagataggaaaggcggggccagggccagactggtctgggccccagtcgagggctgcaggtggtaggctgcgaccccttcctcccacagccccttcccgcccctcgccgggcatccgccgacaggtacataccaagaaattgaattgctgagtcacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggagaacgtgtcaatgacatagggttttggaaatctgaaatcattcatgagttggatgaaatgattggagagacaaatgcacttactgatgtgaagaaaagactggagcgggctttgatggagactgaagcccctcttcaggtagcccgagaatgtctatttcatcgagaaaagagaatgggaatcgacctagttcacgatgaagttgaagcacaactgctgacggaagttgatactattctgtgttgtcaagaaagaatgaagctacatttggataaggctattgcccaacttgcagccaacagagcgtcccagcatgagctggaaaaggacctgagtgacaaacagacggcttaccggatcgacgacaaatgccaccacctgcgcaacacatcagacggtgtcggctacttccgcggagtggagagggtcgatgcaactgtctcagtgcctgagtcctgggccaaatttacagatgacaatattctccgctcccagagtgaacgggcagcttccgctaagctaagagacgacattgaaaacctcttggttgtgactgccaatgagatgtggaatcaattcaacaaagtgaacttgtctttcaccaatcgcattgctgagactgcagatgctaagaataagattcagacgcacttagcaaagaccctgcaggagattttccagactgaaatgaccatagaatccatcaagaaggccatcaaggacaagactgccttcctgaaggtggctcagaccagactggatgagcgcacaagacggccgaacattgagttgtgccgagacatggctcagctacgccttgttaacgaggtacacgaggttgacgacaccatccagaccctgcagcagcgcctgagggatgcagaggacaccctgcagtcgctggtccacatcaaagccacactcgagtatgacctggctgtcaaagccaattccctgtacatcgaccaggaaaaatgcatgagcatgcgcaagagctaccccaacaccctccggctggtcggcttctgctagggaccccaccgggtgtggttttgatacccctaagttaaggctgagccagagcactgtctcagcatttgaaccgaatgctaatatagtcacttattaaaggattatgctgatggaaatgtaccaac

SEQ ID NO: 189991 - DNA, 1820 bp, Homo sapiens
  Payload ID: 17517
  Gene Symbol: TEKT3
  Gene Name: tektin 3
  ENST ID: ENST00000395931
  CDS Start-End: 110-787
agtcgagggctgcaggtggtaggctgcgaccccttcctcccacagccccttcccgcccctcgccgggcatccgccgacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggagaacgtgtcaatgacatagggttttggaaatctgaaatcattcatgagttggatgaaatgattggagagacaaatgcacttactgatgtgaagaaaagactggagcgggctttgatggagactgaagcccctcttcaggtagcccgagaatgtctatttcatcgagaaaagagaatgggaatcgacctagttcacgatgaagttgaagcacaactgctgacggacattgtcacctgagtgtgaagctccacttcccgactctgtattgcagagccaacagagcgtcccagcatgagctggaaaaggacctgagtgacaaacagacggcttaccggatcgacgacaaatgccaccacctgcgcaacacatcagacggtgtcggctacttccgcggagtggagagggtcgatgcaactgtctcagtgcctgagtcctgggccaaatttacagatgacaatattctccgctcccagagtgaacgggcagcttccgctaagctaagagacgacattgaaaacctcttggttgtgactgccaatgagatgtggaatcaattcaacaaagtgaacttgtctttcaccaatcgcattgctgagactgcagatgctaagaataagattcagacgcacttagcaaaggagaagtgaccgttccaggtggggccacatcttgaagaaagccttggagacagcaaatcagaggatgaattgaggtctgtaaagagtctggtgtgtggctggtgtagatggtttgtgtcctgggagaggaacatggaaaaaccctgcaggagattttccagactgaaatgaccatagaatccatcaagaaggccatcaaggacaagactgccttcctgaaggtggctcagaccagactggatgagcgcacaagacggccgaacattgagttgtgccgagacatggctcagctacgccttgttaacgaggtacacgaggttgacgacaccatccagaccctgcagcagcgcctgagggatgcagaggacaccctgcagtcgctggtccacatcaaagccacactcgagtatgacctggctgtcaaagccaattccctgtacatcgaccaggaaaaatgcatgagcatgcgcaagagctaccccaacaccctccggctggtcggcttctgctagggaccccaccgggtgtggttttgatacccctaagttaaggctgagccagagcactgtctcagcatttgaaccgaatgctaatatagtcacttattaaaggattatgctgatggaaatgta

SEQ ID NO: 189992 - DNA, 564 bp, Homo sapiens
  Payload ID: 17517
  Gene Symbol: TEKT3
  Gene Name: tektin 3
  ENST ID: ENST00000539316
  CDS Start-End: 145-564
aaaggcggggccagggccagactggtctgggccccagtcgagggctgcaggtggtaggctgcgaccccttcctcccacagccccttcccgcccctcgccgggcatccgccgacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggca

SEQ ID NO: 189993 - DNA, 970 bp, Homo sapiens
  Payload ID: 17517
  Gene Symbol: TEKT3
  Gene Name: tektin 3
  ENST ID: ENST00000539245
  CDS Start-End: 391-970
agtcgagggctgcaggtggtaggctgcgaccccttcctcccacagccccttcccgcccctcgccgggcatccgccgacaggtacataccaagaaattgaattgctgagtcacaggagagatttacaaatagtgttttggcatcatggaacgtaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggagaacgtgtcaatgacatagggttttggaaatctgaaatcattcatgagttggatgaaatgattggagagacaaatgcacttactgatgtgaagaaaagactggagcgggctttgatggagactgaagcccctcttcaggtagcccgagaatgtctatttcatcgagaaaagagaatgggaatcgacctagttcacgatgaagttgaagcacaactgctgacggaagttgatactattctgtgttgtcaagaaagaatgaagctacatttggataaggctattgcccaacttgcagccaacagagcgtcccagcatgagctggaaaaggacctgagtgacaaacagacggcttaccggatcgacgacaaatgccaccacctgcgcaacacatcagacggtgtcggctacttccgcggagtggagagggtcgatgcaactgtctcagtgcctgagtcctgggccaaatttacagatgacaatattctccgctcccagagtgaacgggcagcttccgctaagctaagagacgacattgaaaacctcttggttgtgactgccaatgagatgtggaatcaattcaacaaagtgaacttgtctttcaccaatcgcattgctgagactgcagatgctaagaata

SEQ ID NO: 189994 - DNA, 483 bp, Homo sapiens
  Payload ID: 17517
  Gene Symbol: TEKT3
  Gene Name: tektin 3
  ENST ID: ENST00000543896
  CDS Start-End: 238-483
gagggctgcaggtggtaggctgcgaccccttcctcccacagccccttcccgcccctcgccgggcatccgccgacaggctggagtgcaatggcatgatctcagctcaccggaacctccgcctcccagattcaagcgattctcctgcctcagccccctgagtagctgggattacaggtacataccaagaaattgaattgctgagtcacaggagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccc

SEQ ID NO: 189995 - DNA, 583 bp, Homo sapiens
  Payload ID: 17517
  Gene Symbol: TEKT3
  Gene Name: tektin 3
  ENST ID: ENST00000536146
  CDS Start-End: 141-583
actccagcctgggggacagagcgagactccatctcaaaaaaaaaaaaaagaattgactgagttagaatttagagagtaagttaatcattgtgaaagatgcgcaccaccaaagagagatttacaaatagtgttttggcatcatggaacgtgtaggttgtactttaacgacaacttacgcccaccctagaccaacaccaaccaactttctaccagccatcagtaccatggcctcaagctacagggaccgctttccccactccaatttgacccatagcctgagccttccttggagacccagcacatactacaaagtcgcctccaattccccaagcgtggccccgtactgcaccagatcacagagggtgtccgagaataccatgcttccctttgtttccaacagaaccactttcttcacaagatacacaccggatgactggtacaggtccaatttaaccaactatcaagagtccaacacttcccgacataattcggagaaactaagagtggatacatctcgcctgattcaagacaaatatcaacaaacaagaaaaactcaggcagacacaacccaaaatctgggaga

SEQ ID NO: 189996 - DNA, 1505 bp, Homo sapiens
  Payload ID: 17518
  Gene Symbol: TEKT4
  Gene Name: tektin 4
  Uniprot ID: Q8WW24
  ENST ID: ENST00000295201
  CDS Start-End: 138-1445
tcacccaagcgactgggagccgcgtcctgctctgggactgagccgttggagctgccccgctgaccgcactaggctgaccgcaaccggctgaccacacacagtcctcactcccctggccctggtgggcggcaggcaccatggcgcagacagtgccgccctgcgagctgccctgcaaagagtacgacgtggcccgtaacacgggcgcctacacgtcctccggcctggccaccgccagcttccgcacctccaagtacctgctggaggagtggttccagaactgctatgctcgctaccaccaggccttcgccgaccgcgaccagtcggagcggcagcggcacgagagccagcagctggccacagagacccaggcgctggcgcagcgcacgcagcaagactccacgcgcacagtgggcgagcgactgcaggacacgcacagctggaagtcggagctgcagcgtgagatggaggcgctggctgcggagaccaacttgctcctggcccagaagcaacggctggagcgcgccctggacgccacagaggtgcccttctccatcaccactgacaacctgcagtgccgtgagcgccgcgagcaccccaacctcgtgcgcgaccatgtggaaacggagctgctgaaggaagccgagctcatccggaacattcaggagctgctgaagagaaccatcatgcaagcagtgagccagatccgactgaaccgggagcacaaggagacctgcgagatggactggtcagacaagatggaggcctacaacatcgacgagacctgcgggcgccaccacagccagagcaccgaggtgcaggctcatccgtactccaccaccttccaagagagcgcctccaccccggagacccgggccaagttcacgcaggacaatctgtgccgtgcccagcgcgagcgcctggcctcggccaacctgcgggtgctggtggactgcatccttcgcgacacctccgaggacctgcggctccagtgcgacgccgtgaacctggccttcgggcgccgctgtgaggagctggaggacgcgcggtacaagctgcatcaccacctgcacaagacactgcgggaaatcacagatcaggaacacaacgtggcggcactgaagcaggccatcaaggacaaagaggcacctctgcacgtagcccagacccggctgtacctgcgctcgcaccggcccaacatggagctgtgccgtgacgcagcccagttcaggctgttgagtgaggtggaggagctgaacatgtccctcacagcactgcgagagaagcttctagaagcggagcagtccctgcgcaacctcgaggacatccacatgagcctggagaaggacattgccgccatgaccaacagtctcttcatcgaccgccagaagtgcatggcccatcgtactcgctaccccaccatcctgcagctggctggctaccagtgagcagcggcacggtgcttccccccagtcccccaaataaacagcgcgttagctttctgcaca

SEQ ID NO: 189997 - DNA, 1612 bp, Homo sapiens
  Payload ID: 17519
  Gene Symbol: TEKT5
  Gene Name: tektin 5
  Uniprot ID: Q96M29
  ENST ID: ENST00000283025
  CDS Start-End: 73-1530
actttcacctttcctggtgatgcctttggctccttgagctgagttttgcccgagtggggctcatgagggaggatggagtttcttgggactactcagaccgccagttactgtggtcccaagaaatgctgtggcttgacctcactgccagctgtacaggcgccagtgatccaggaatgctatcagccctactacctgcccgggtaccgctacctcaattcatggaggcctagcctcttctacaagatagccaacgtccagacctgcccggacgagagcaccagtaccctgcggccgcccaccatcctgcccacactgcgctccgcactcttctctcgctatagcccccacgactgggaccagtccaaccagctgcaggtgcgtggggccgaggcctcccggctgtgggccagccggctgacggatgactccatgaggctcttgcaggacaaggaccagctgacgcaccagatgcaggagggcacctgccggaacctgggccagaggctgtcggacattggcttctggaagtcagagctgagctatgagctggacaggcttctgactgagaaccagaacttggagacggtcaagaggcggctggagtgcgcggccaatgaggtgaactgcccattgcaggtggccttggagtgtctgtaccatcgagagaagaggattgggattgatttggtccatgacaacgtggagaaaaaccttatccgggaagtggatttgctaaaatgttgccaagaacagatgagaaaattagctcaaagaattgatatccagatgcgggataaccgggatgctcagcacgtgctggagagggacctcgaagacaaaagctcggcccagtgtatcgatgagaagtgctttaacctgagaaatacgtcagactgcatcagcttcttccacggcatggagaaaattgacggcacgatctccgtacctgagacctgggccaagttcagtaacgacaacatcaaacactctcagaacatgcgggccaactccatccagctgcgggaggaggcggagcacctctttgagaccttgtcggatcagatgtggaggcagttcacagacaccaacctggccttcaacgcccgcatctctgaggtgacggatgtgaagaataagctgcagacgcagctggcgaagacgctgcaggagatcttccaggccgagaacaccatcatgctgctggaaaggtccatcatggccaaggagggcccgctgaaggtggcccagacaaggctggagtgccggacccggcgccccaacatggagctgtgcagggacatcccgcagttgaagctggtgaacgaggtgttcaccatcgacgacaccctgcagaccctcaagctgcggctgcgggagacacaggacacgctgcagctgctggtcatgaccaagtgccggctggagcacgagctcgccatcaaggccaacaccctctgcatcgacaaggagaagtgcatgggcatgcgtaagaccttcccctgcaccccgcgcctggtgggccacacctgagcaccgccctggcgcctcattccgcgctggcgtaaaattggaaaaggctgagaaacaaagtaaaacagtattttgtttgaaa

SEQ ID NO: 189998 - DNA, 771 bp, Homo sapiens
  Payload ID: 17519
  Gene Symbol: TEKT5
  Gene Name: tektin 5
  ENST ID: ENST00000576638
  CDS Start-End: 212-771
gaacagattgtggcaagggtggatgtgagtcccttctgctcagggtctacatacagctacaggaagaatacgttctttctgctgcttcccacaggtggccttggagtgtctgtaccatcgagagaagaggattgggattgatttggtccatgacaacgtggagaaaaaccttatccgggaagtggatttgctaaaatgttgccaagaacagatgagaaaattagctcaaagaattgatatccagatgcgggataaccgggatgctcagcacgtgctggagagggacctcgaagacaaaagctcggcccagtgtatcgatgagaagtgctttaacctgagaaatacgtcagactgcatcagcttcttccacggcatggagaaaattgacggcacgatctccgtacctgagacctgggccaagttcagtaacgacaacatcaaacactctcagaacatgcgggccaactccatccagctgcgggaggaggcggagcacctctttgagaccttgtcggatcagatgtggaggcagttcacagacaccaacctggccttcaacgcccgcatctctgaggtgacggatgtgaagaataagctgcagacgcagctggcgaagacgctgcaggagatcttccaggccgagaacaccatcatgctgctggaaaggtccatcatggccaaggagggcccgctgaaggtggcccagacaaggctggagtgccggacccggcgccccaacatggagctgtgcagggacatcccgcagttgaa

SEQ ID NO: 189999 - DNA, 3825 bp, Homo sapiens
  Payload ID: 17520
  Gene Symbol: TTI1
  Gene Name: TELO2 interacting protein 1
  Uniprot ID: O43156
  ENST ID: ENST00000373447
  CDS Start-End: 107-3376
acttagcgcgtcacttccggcgaggcagaggaggcgggagagtgagagaaaggctggaagacgagcctgcaggatgtttcctcaatgaggggaaggctgctgcacaatggcagtttttgatactcctgaggaggcctttggtgtcttacgtccagtctgtgttcagctcacaaagacccagacagtggagaatgtggagcatctgcagacacgactacaagctgtgagtgacagtgcccttcaggaacttcagcagtacatcctcttccctctgcgatttaccctgaagaccccaggtcccaaaagagagcgtttgatccaaagtgtggtggaatgcctcacatttgtcctttcttcaacatgtgtgaaagaacaggagcttctccaggaactcttttcagaactctctgcttgtctgtattcacccagctcccaaaaacctgcggctgtgtccgaggagttgaaattggctgtgatccagggacttagcacattaatgcactcagcttatggggacatcattctgactttttatgagccctccattctgccacgtttaggatttgctgtatctttactgttaggccttgcagaacaggagaaatcaaagcaaattaaaattgctgccttaaaatgtttacaggttctactcttgcagtgtgattgtcaggaccatccaaggtcattggatgaacttgaacaaaagcagctgggggatttgtttgcctcttttttacctggaatctcaactgcactgaccaggcttatcacaggagactttaaacaaggtcacagcattgtcgtatcttccctaaagatcttttacaagacagtgagcttcattatggctgatgaacagctcaaaagaatctcaaaggtccaagcaaaacctgcagttgagcacagagtagcagagctgatggtttacagggaagcagattgggtaaaaaagactggcgacaagttgactatccttattaaaaagataattgagtgtgtttctgttcacccacactggaaggtgagactggaactggtagaacttgtggaggaccttcttttgaagtgcagtcaatcattggtcgaatgtgctggtccccttctgaaggccttagtgggactagtaaatgatgagagtcctgaaatccaagcccagtgcaataaagttctgagacattttgcagatcaaaaagtagtggtgggcaacaaagccctcgctgacatcttgtcagaaagcctgcattcccttgccacatctcttcctcgcctaatgaactcccaagatgaccagggcaaattctctactctttccttgttacttggttatctgaaactcttgggcccaaaaataaactttgtcctcaactctgtggcccatctccagcggctttccaaagcactcatccaagttctagagctagacgtggctgacatcaagattgttgaggaacggcgttggaactctgatgatctgaatgcttctccaaagacctcagccacacagccttggaaccgcatccagaggagatatttccgcttcttcactgatgagagaatcttcatgctcttgaggcaggtttgtcagctacttggttattatgggaatctttatttgcttgtggatcactttatggaactttaccatcaatctgtggtttaccggaagcaagctgccatgatccttaatgaactggttacaggggctgctgggctggaggttgaggatcttcacgaaaaacatattaaaacaaacccagaagaactgagagagattgtgacatctatacttgaagaatacacaagtcaagaaaattggtatttggttacctgtcttgaaactgaggaaatgggagaggagctgatgatggagcacccaggcctccaagccatcacgtctggtgaacacacctgccaagttacatcttttctagccttctcaaagccaagtcccactatttgctccatgaacagtaacatctggcaaatatgcattcagttggaaggaattggccagtttgcatatgcactaggaaaagacttctgtttgctcttgatgtcagccctttatccagtactggagaaggctggagaccaaaccctactcattagtcaggtggctaccagcaccatgatggacgtttgccgtgcttgtggctacgactccctgcagcacctgatcaatcaaaattcagactatttagtgaatgggatctctttaaatctgcgtcatctggctctgcatcctcataccccaaaggtcctggaagtcatgctgcggaactcagatgctaacctgcttcctttggtggcagatgtggttcaagatgtcttggccaccctggaccaattttacgataagagagctgcttcctttgtcagcgttctgcatgctctgatggcagcattagcccagtggttcccagacacaggtaatcttgggcacctccaagagcaaagtttaggagaagagggaagtcatttgaaccaaagaccagcagctcttgagaagagcaccaccacagctgaagacatcgaacagtttttgctgaactacctcaaagagaaggatgtggcagatggaaatgtctcggattttgataatgaagaagaggaacagtcagtccctcccaaagtggatgagaatgacacccgtccagatgtggagccaccactgccattgcagatccaaatagccatggacgtgatggaacgctgcatccacttgttgtcagataaaaatctgcaaatccgcctgaaggtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgagggtgacctgaataaagtggctgatgcctgcttgatttacctcagtgtcaaacagcccgtgaaattacaagaggctgccaggagcgtcttcctccacttgatgaaggtggacccagactccacctggttcctcctgaacgagctttactgccccgtgcagttcacacctccccaccccagcctccaccctgtgcagctgcacggggccagcgggcagcagaacccctacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatgtttcataccttgtgttgtcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagtatgatcaaaagctca

SEQ ID NO: 190000 - DNA, 3958 bp, Homo sapiens
  Payload ID: 17520
  Gene Symbol: TTI1
  Gene Name: TELO2 interacting protein 1
  Uniprot ID: O43156
  ENST ID: ENST00000373448
  CDS Start-End: 240-3509
gcgtcacttccggcgaggcagaggaggcgggagagtgagagaaaggctggaagacgagacctgctcactctgtcaccgaggctagagtacagtggcacaatcacagctcattgcagcctcaacctcccaggctcaatcgatccttccaactgagcctccctagcagctgggactattagtgcacaccaccacacctagcctgcaggatgtttcctcaatgaggggaaggctgctgcacaatggcagtttttgatactcctgaggaggcctttggtgtcttacgtccagtctgtgttcagctcacaaagacccagacagtggagaatgtggagcatctgcagacacgactacaagctgtgagtgacagtgcccttcaggaacttcagcagtacatcctcttccctctgcgatttaccctgaagaccccaggtcccaaaagagagcgtttgatccaaagtgtggtggaatgcctcacatttgtcctttcttcaacatgtgtgaaagaacaggagcttctccaggaactcttttcagaactctctgcttgtctgtattcacccagctcccaaaaacctgcggctgtgtccgaggagttgaaattggctgtgatccagggacttagcacattaatgcactcagcttatggggacatcattctgactttttatgagccctccattctgccacgtttaggatttgctgtatctttactgttaggccttgcagaacaggagaaatcaaagcaaattaaaattgctgccttaaaatgtttacaggttctactcttgcagtgtgattgtcaggaccatccaaggtcattggatgaacttgaacaaaagcagctgggggatttgtttgcctcttttttacctggaatctcaactgcactgaccaggcttatcacaggagactttaaacaaggtcacagcattgtcgtatcttccctaaagatcttttacaagacagtgagcttcattatggctgatgaacagctcaaaagaatctcaaaggtccaagcaaaacctgcagttgagcacagagtagcagagctgatggtttacagggaagcagattgggtaaaaaagactggcgacaagttgactatccttattaaaaagataattgagtgtgtttctgttcacccacactggaaggtgagactggaactggtagaacttgtggaggaccttcttttgaagtgcagtcaatcattggtcgaatgtgctggtccccttctgaaggccttagtgggactagtaaatgatgagagtcctgaaatccaagcccagtgcaataaagttctgagacattttgcagatcaaaaagtagtggtgggcaacaaagccctcgctgacatcttgtcagaaagcctgcattcccttgccacatctcttcctcgcctaatgaactcccaagatgaccagggcaaattctctactctttccttgttacttggttatctgaaactcttgggcccaaaaataaactttgtcctcaactctgtggcccatctccagcggctttccaaagcactcatccaagttctagagctagacgtggctgacatcaagattgttgaggaacggcgttggaactctgatgatctgaatgcttctccaaagacctcagccacacagccttggaaccgcatccagaggagatatttccgcttcttcactgatgagagaatcttcatgctcttgaggcaggtttgtcagctacttggttattatgggaatctttatttgcttgtggatcactttatggaactttaccatcaatctgtggtttaccggaagcaagctgccatgatccttaatgaactggttacaggggctgctgggctggaggttgaggatcttcacgaaaaacatattaaaacaaacccagaagaactgagagagattgtgacatctatacttgaagaatacacaagtcaagaaaattggtatttggttacctgtcttgaaactgaggaaatgggagaggagctgatgatggagcacccaggcctccaagccatcacgtctggtgaacacacctgccaagttacatcttttctagccttctcaaagccaagtcccactatttgctccatgaacagtaacatctggcaaatatgcattcagttggaaggaattggccagtttgcatatgcactaggaaaagacttctgtttgctcttgatgtcagccctttatccagtactggagaaggctggagaccaaaccctactcattagtcaggtggctaccagcaccatgatggacgtttgccgtgcttgtggctacgactccctgcagcacctgatcaatcaaaattcagactatttagtgaatgggatctctttaaatctgcgtcatctggctctgcatcctcataccccaaaggtcctggaagtcatgctgcggaactcagatgctaacctgcttcctttggtggcagatgtggttcaagatgtcttggccaccctggaccaattttacgataagagagctgcttcctttgtcagcgttctgcatgctctgatggcagcattagcccagtggttcccagacacaggtaatcttgggcacctccaagagcaaagtttaggagaagagggaagtcatttgaaccaaagaccagcagctcttgagaagagcaccaccacagctgaagacatcgaacagtttttgctgaactacctcaaagagaaggatgtggcagatggaaatgtctcggattttgataatgaagaagaggaacagtcagtccctcccaaagtggatgagaatgacacccgtccagatgtggagccaccactgccattgcagatccaaatagccatggacgtgatggaacgctgcatccacttgttgtcagataaaaatctgcaaatccgcctgaaggtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgagggtgacctgaataaagtggctgatgcctgcttgatttacctcagtgtcaaacagcccgtgaaattacaagaggctgccaggagcgtcttcctccacttgatgaaggtggacccagactccacctggttcctcctgaacgagctttactgccccgtgcagttcacacctccccaccccagcctccaccctgtgcagctgcacggggccagcgggcagcagaacccctacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatgtttcataccttgtgttgtcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagtatgatcaaaagctca

SEQ ID NO: 190001 - DNA, 3791 bp, Homo sapiens
  Payload ID: 17520
  Gene Symbol: TTI1
  Gene Name: TELO2 interacting protein 1
  Uniprot ID: O43156
  ENST ID: ENST00000449821
  CDS Start-End: 88-3357
cttgctttgaacttgacatttttactgaacagtttccttcctccagcctgcaggatgtttcctcaatgaggggaaggctgctgcacaatggcagtttttgatactcctgaggaggcctttggtgtcttacgtccagtctgtgttcagctcacaaagacccagacagtggagaatgtggagcatctgcagacacgactacaagctgtgagtgacagtgcccttcaggaacttcagcagtacatcctcttccctctgcgatttaccctgaagaccccaggtcccaaaagagagcgtttgatccaaagtgtggtggaatgcctcacatttgtcctttcttcaacatgtgtgaaagaacaggagcttctccaggaactcttttcagaactctctgcttgtctgtattcacccagctcccaaaaacctgcggctgtgtccgaggagttgaaattggctgtgatccagggacttagcacattaatgcactcagcttatggggacatcattctgactttttatgagccctccattctgccacgtttaggatttgctgtatctttactgttaggccttgcagaacaggagaaatcaaagcaaattaaaattgctgccttaaaatgtttacaggttctactcttgcagtgtgattgtcaggaccatccaaggtcattggatgaacttgaacaaaagcagctgggggatttgtttgcctcttttttacctggaatctcaactgcactgaccaggcttatcacaggagactttaaacaaggtcacagcattgtcgtatcttccctaaagatcttttacaagacagtgagcttcattatggctgatgaacagctcaaaagaatctcaaaggtccaagcaaaacctgcagttgagcacagagtagcagagctgatggtttacagggaagcagattgggtaaaaaagactggcgacaagttgactatccttattaaaaagataattgagtgtgtttctgttcacccacactggaaggtgagactggaactggtagaacttgtggaggaccttcttttgaagtgcagtcaatcattggtcgaatgtgctggtccccttctgaaggccttagtgggactagtaaatgatgagagtcctgaaatccaagcccagtgcaataaagttctgagacattttgcagatcaaaaagtagtggtgggcaacaaagccctcgctgacatcttgtcagaaagcctgcattcccttgccacatctcttcctcgcctaatgaactcccaagatgaccagggcaaattctctactctttccttgttacttggttatctgaaactcttgggcccaaaaataaactttgtcctcaactctgtggcccatctccagcggctttccaaagcactcatccaagttctagagctagacgtggctgacatcaagattgttgaggaacggcgttggaactctgatgatctgaatgcttctccaaagacctcagccacacagccttggaaccgcatccagaggagatatttccgcttcttcactgatgagagaatcttcatgctcttgaggcaggtttgtcagctacttggttattatgggaatctttatttgcttgtggatcactttatggaactttaccatcaatctgtggtttaccggaagcaagctgccatgatccttaatgaactggttacaggggctgctgggctggaggttgaggatcttcacgaaaaacatattaaaacaaacccagaagaactgagagagattgtgacatctatacttgaagaatacacaagtcaagaaaattggtatttggttacctgtcttgaaactgaggaaatgggagaggagctgatgatggagcacccaggcctccaagccatcacgtctggtgaacacacctgccaagttacatcttttctagccttctcaaagccaagtcccactatttgctccatgaacagtaacatctggcaaatatgcattcagttggaaggaattggccagtttgcatatgcactaggaaaagacttctgtttgctcttgatgtcagccctttatccagtactggagaaggctggagaccaaaccctactcattagtcaggtggctaccagcaccatgatggacgtttgccgtgcttgtggctacgactccctgcagcacctgatcaatcaaaattcagactatttagtgaatgggatctctttaaatctgcgtcatctggctctgcatcctcataccccaaaggtcctggaagtcatgctgcggaactcagatgctaacctgcttcctttggtggcagatgtggttcaagatgtcttggccaccctggaccaattttacgataagagagctgcttcctttgtcagcgttctgcatgctctgatggcagcattagcccagtggttcccagacacaggtaatcttgggcacctccaagagcaaagtttaggagaagagggaagtcatttgaaccaaagaccagcagctcttgagaagagcaccaccacagctgaagacatcgaacagtttttgctgaactacctcaaagagaaggatgtggcagatggaaatgtctcggattttgataatgaagaagaggaacagtcagtccctcccaaagtggatgagaatgacacccgtccagatgtggagccaccactgccattgcagatccaaatagccatggacgtgatggaacgctgcatccacttgttgtcagataaaaatctgcaaatccgcctgaaggtcttggatgtgctggatctgtgtgtggttgttcttcagtcccacaaaaaccagctgcttcccttggctcatcaggcctggccctcgctcgttcaccgactcacacgggacgcccccctggcagtgcttagagccttcaaggttttacgtaccctgggaagcaagtgtggtgactttcttcgcagccggttctgcaaagatgtcctgccaaagctggctggctccctagtcacccaggcccccatcagtgccagggctggaccagtttactcgcacacgctggccttcaagttgcagctggctgtcttacagggcctgggccccctctgtgagagactggacctaggtgagggtgacctgaataaagtggctgatgcctgcttgatttacctcagtgtcaaacagcccgtgaaattacaagaggctgccaggagcgtcttcctccacttgatgaaggtggacccagactccacctggttcctcctgaacgagctttactgccccgtgcagttcacacctccccaccccagcctccaccctgtgcagctgcacggggccagcgggcagcagaacccctacacgaccaacgtgctccagctgctcaaggagctgcagtgaccctgctcccccaccacagaggccaccgatccctcccctactgccagccagaagctgggctgaccccaccccggccataggcggtggcagcggcagcagagaaggtgaattagttagccaatcgatttataaattgatcgatcacacaactgcttagaaatggattgaaggaaagtagctgactattatttatgtttcataccttgtgttgtcaagtgacattgtctggtggctctaagggtttaaccccttagcctaccatctctatagccccagctccctcacaggccacacacacacacacacaagaggtcagttcccctccatctgcatacacctccctgtcttcaaataatgagatggaactaatttgttttacctaacctgatctttgggaaacaaacggaaataaagacacttcttggatgaaaagt

SEQ ID NO: 190002 - DNA, 432 bp, Homo sapiens
  Payload ID: 17520
  Gene Symbol: TTI1
  Gene Name: TELO2 interacting protein 1
  ENST ID: ENST00000620381
  CDS Start-End: 1-98
aacagtttttgctgaactacctcaaagagaaggatgtggcagatggaaatgtctcggattttgataatgaagaaggtaacttgtttattttggcttagctggttttttctttctgaaacagattattgtaaaaatggtgaaacatcattacagaaagggtagaaataagaaaagttactcataaccttaccaggctaacatagctattctcctgttttgtgtaatctttttccattcttttctgttacaaaactgtttttccgtggttgcagctgtgtaccctttttgtgtttagttataagcaactctgcttattgccgttgaattttgatcattaacgttttaatagctgttactaagtgtccatcccctgtaggacatttaggttgcttctggcttaataataactctaataaacagtgctgcggtgga

SEQ ID NO: 190003 - DNA, 2242 bp, Homo sapiens
  Payload ID: 17521
  Gene Symbol: TTI2
  Gene Name: TELO2 interacting protein 2
  Uniprot ID: Q6NXR4
  ENST ID: ENST00000360742
  CDS Start-End: 497-2023
agacaccggcgggcgcgagccgttgcaggtacctgggggtggttaagttggtgacatggctcagaagtttatttctttaaatttttaagttttttttctttttagtcttcagaaaggcaacagtagtcttttaacgtcactgttaaaagtgtaagactcttttactccctgagagtcccctttccctttcttgcgtcctttcctctttattcttttttttttttttttttttactgagacggagtctcactctgtcgcccaggctggagtgcagtggcgcgatctcggctcactgcaaactccgcctcccgggttcaccctttctctttattcttatcccggtcagactcgccccctcctccaagacatctctctgttttattttatttgattttagttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaatgtaaaagatgcagttcttaaagacctcggtgatctaatagaagccacagaatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattccctggtcggccctgcatggcagacgggcctgcatcacttggcaggacccgtttatatttttgccatcacacacagcttggagcaaccatggaccactccgagatctcgggaagttgctagggaggtgctcacctcactgcttcaagttactgaatgcggttctgtggcaggattcctacatggagaaaatgaagatgagaaagggagactttcggtgatactagggcttctcaaacccgacttgtataaggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtgccagctgctgatttgctccagtataacagagcccaggtcctataccatgccatttccaaccacctgtacacaccagagcaccacctcattcaggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggttggggatcctaactgtccggcacttaaagaggctggagagagtcatcattggttatctggaggtttatgatggacctgaggaggaagctagactgaagatattggaaaccctaaaacttctcatgcaacatacttggcccagagtttcctgcagacttgtggtcttactgaaggccctcttgaaactgatttgtgatgtagcaagggatccaaaccttacacctgagtctgttaagagcgccctgctacaggaggccacagactgcctgattctcctggaccgctgttctcaaggacgggtaaagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaatttgtatgaatggagttatttaagaaaaaaagatatttttacacgaaactttgtaagtgaaagctgctttttccttccttcctttccttttacctccataagaatagggaaagtagaacaagaaaaaattgaactccttccatttctaaataaagtttgggagaaaaaagga

SEQ ID NO: 190004 - DNA, 2363 bp, Homo sapiens
  Payload ID: 17521
  Gene Symbol: TTI2
  Gene Name: TELO2 interacting protein 2
  Uniprot ID: Q6NXR4
  ENST ID: ENST00000431156
  CDS Start-End: 620-2146
gttaaatcgatccttgaagttcaggtcagacgggtaatgtgcccacgtcgtaacaaggttcaagggtggcacatctcacacaagcgtatgaacacccaatcatcacgctcatgaactacaaaaggatcatcttatagttgacattaaggagtgccaagtatgtgccactaatttacacatagggtgactaccgtaatgcgatacatccattcttcacgtataaaatcctggatattttcaaagtcccactgagattctgtgattattcttttgtttctaccttagcaaaggaaaacagaaacacaattagcgagcggattattatatatgcaaatttattctctatagttccacctctccgtcattttcccgagcctggatctttattgctttacgaccatacgtcgtgaaataagaaggtgttgcggcagtactggcggaagctagccttgcgttttgcggcagcaatatgagctaggtccggatcctgttagacaccggcgggcgcgagccgttgcagttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaatgtaaaagatgcagttcttaaagacctcggtgatctaatagaagccacagaatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattccctggtcggccctgcatggcagacgggcctgcatcacttggcaggacccgtttatatttttgccatcacacacagcttggagcaaccatggaccactccgagatctcgggaagttgctagggaggtgctcacctcactgcttcaagttactgaatgcggttctgtggcaggattcctacatggagaaaatgaagatgagaaagggagactttcggtgatactagggcttctcaaacccgacttgtataaggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtgccagctgctgatttgctccagtataacagagcccaggtcctataccatgccatttccaaccacctgtacacaccagagcaccacctcattcaggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggttggggatcctaactgtccggcacttaaagaggctggagagagtcatcattggttatctggaggtttatgatggacctgaggaggaagctagactgaagatattggaaaccctaaaacttctcatgcaacatacttggcccagagtttcctgcagacttgtggtcttactgaaggccctcttgaaactgatttgtgatgtagcaagggatccaaaccttacacctgagtctgttaagagcgccctgctacaggaggccacagactgcctgattctcctggaccgctgttctcaaggacgggtaaagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaatttgtatgaatggagttatttaagaaaaaaagatatttttacacgaaactttgtaagtgaaagctgctttttccttccttcctttccttttacctccataagaatagggaaagtagaacaagaaaaaattgaactccttccatttctaaataaagtttgggagaaaaaag

SEQ ID NO: 190005 - DNA, 1588 bp, Homo sapiens
  Payload ID: 17521
  Gene Symbol: TTI2
  Gene Name: TELO2 interacting protein 2
  ENST ID: ENST00000520636
  CDS Start-End: 100-1533
ttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaatgtaaaagatgcagttcttaaagacctcggtgatctaatagaagccacagaatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattccctggtcggccctgcatggcagacgggcctgcatcacttggcaggacccgtttatatttttgccatcacacacagcttggagcaaccatggaccactccgagatctcgggaagttgctagggaggtgctcacctcactgcttcaagttactgaatgcggttctgtggcaggattcctacatggagaaaatgaagatgagaaagggagactttcggtgatactagggcttctcaaacccgacttgtataaggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggttggggatcctaactgtccggcacttaaagaggctggagagagtcatcattggttatctggaggtttatgatggacctgaggaggaagctagactgaagatattggaaaccctaaaacttctcatgcaacatacttggcccagagtttcctgcagacttgtggtcttactgaaggccctcttgaaactgatttgtgatgtagcaagggatccaaaccttacacctgagtctgttaagagcgccctgctacaggaggccacagactgcctgattctcctggaccgctgttctcaaggacgggtaaagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaatttgtatg

SEQ ID NO: 190006 - DNA, 485 bp, Homo sapiens
  Payload ID: 17521
  Gene Symbol: TTI2
  Gene Name: TELO2 interacting protein 2
  ENST ID: ENST00000523305
  CDS Start-End: 183-485
ggatcctgttagacaccggcgggcgcgagccgttgcagtcttcagaaaggcaacagtagtcttttaacgtcactgttaaaagtttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaatgtaaaagatgcagttcttaaagacctcggtgatctaatagaagccacagaatttgataggttatttgaggggactggtgcacggctccgcggaatgccggagacactggggcaggtagcaaaagccctggagaagtatgcagccccctccaaggaggaggaaggt

SEQ ID NO: 190007 - DNA, 2516 bp, Homo sapiens
  Payload ID: 17521
  Gene Symbol: TTI2
  Gene Name: TELO2 interacting protein 2
  Uniprot ID: Q6NXR4
  ENST ID: ENST00000613904
  CDS Start-End: 326-1852
aaggtgttgcggcagtactggcggaagctagccttgcgttttgcggcagcaatatgagctaggtccggatcctgttagacaccggcgggcgcgagccgttgcaggtacctgggggtggttaagttggtgacatggctcagaagtttatttctttaaatttttaagttttttttctttttagtcttcagaaaggcaacagtagtcttttaacgtcactgttaaaagtttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaatgtaaaagatgcagttcttaaagacctcggtgatctaatagaagccacagaatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattccctggtcggccctgcatggcagacgggcctgcatcacttggcaggacccgtttatatttttgccatcacacacagcttggagcaaccatggaccactccgagatctcgggaagttgctagggaggtgctcacctcactgcttcaagttactgaatgcggttctgtggcaggattcctacatggagaaaatgaagatgagaaagggagactttcggtgatactagggcttctcaaacccgacttgtataaggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtgccagctgctgatttgctccagtataacagagcccaggtcctataccatgccatttccaaccacctgtacacaccagagcaccacctcattcaggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggttggggatcctaactgtccggcacttaaagaggctggagagagtcatcattggttatctggaggtttatgatggacctgaggaggaagctagactgaagatattggaaaccctaaaacttctcatgcaacatacttggcccagagtttcctgcagacttgtggtcttactgaaggccctcttgaaactgatttgtgatgtagcaagggatccaaaccttacacctgagtctgttaagagcgccctgctacaggaggccacagactgcctgattctcctggaccgctgttctcaaggacgggtaaagggtctcctggccaaaattccccaaagctgtgaagacagaaaagtggtgaactatatcagaaaagtgcagcaggtttctgaaggcgcaccctacaatggaacttaagacttgtattactttcccaagaggaaaggattttcttcccatcccaatttgtatgaatggagttatttaagaaaaaaagatatttttacacgaaactttgtaagtgaaagctgctttttccttccttcctttccttttacctccataagaatagggaaagtagaacaagaaaaaattgaactccttccatttctaaataaagtttgggagaaaaaaggacaccaagtaatgtagcatttaaaatttagaaatatttacatccgtcatctcatcccagattcaagaactcatctgttaagtttctcgggcacaagctgttacttcaacacatatgctataaaaacactcttgttcacaacttagctttcttcactcactccagatttcttgccccactgacgtggcataaataataaaaacacaaatattgtgttcagtacaacacaaaagagcaaaaactggaggtgtgtatgtgtttaagataaaaaaaaaaaaaaaacagttctgcatgttcagtcctgggtataaatgctgaaagggaaatcacgtggttttggctttggccacgggctctgtctcctgctcgtattctatttccacataggctcgttttctctgcagtggtcctctcaagggcattttgcctttgtgtttcgcactaagg

SEQ ID NO: 190008 - DNA, 4018 bp, Homo sapiens
  Payload ID: 17522
  Gene Symbol: TERT
  Gene Name: telomerase reverse transcriptase
  Uniprot ID: O14746
  ENST ID: ENST00000310581
  CDS Start-End: 59-3457
caggcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaa

SEQ ID NO: 190009 - DNA, 3210 bp, Homo sapiens
  Payload ID: 17522
  Gene Symbol: TERT
  Gene Name: telomerase reverse transcriptase
  Uniprot ID: O14746
  ENST ID: ENST00000334602
  CDS Start-End: 1-3210
atgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactga

SEQ ID NO: 190010 - DNA, 2992 bp, Homo sapiens
  Payload ID: 17522
  Gene Symbol: TERT
  Gene Name: telomerase reverse transcriptase
  Uniprot ID: O14746
  ENST ID: ENST00000460137
  CDS Start-End: 1-2388
atgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggacaggctcacggaggtcatcgccagcatcatcaaaccccagaacacgtactgcgtgcgtcggtatgccgtggtccagaaggccgcccatgggcacgtccgcaaggccttcaagagccacgtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactga

SEQ ID NO: 190011 - DNA, 2486 bp, Homo sapiens
  Payload ID: 17522
  Gene Symbol: TERT
  Gene Name: telomerase reverse transcriptase
  Uniprot ID: O14746
  ENST ID: ENST00000508104
  CDS Start-End: 1-2424
atgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggtgaggcccgtgcc

SEQ ID NO: 190012 - DNA, 10695 bp, Homo sapiens
  Payload ID: 17523
  Gene Symbol: TEP1
  Gene Name: telomerase-associated protein 1
  Uniprot ID: Q99973
  ENST ID: ENST00000262715
  CDS Start-End: 42-7925
ggaatcggacgccccaggcatatacaagctgagtttcagccatggaaaaactccatgggcatgtgtctgcccatccagacatcctctccttggagaaccggtgcctggctatgctccctgacttacagcccttggagaaactacatcagcatgtatctacccactcagatatcctctccttgaagaaccagtgcctagccacgcttcctgacctgaagaccatggaaaaaccacatggatatgtgtctgcccacccagacatcctctccttggagaaccagtgcctggccacactttctgacctgaagaccatggagaaaccacatggacatgtttctgcccacccagacatcctctccttggagaaccggtgcctggccaccctctctagtctaaagagcactgtgtctgccagccccttgttccagagtctacagatatctcacatgacgcaagctgatttgtaccgtgtgaacaacagcaattgcctgctctctgagcctccaagttggagggctcagcatttctctaagggactagacctttcaacctgccctatagccctgaaatccatctctgccacagagacagctcaggaagcaactttgggtcgttggtttgattcagaagagaagaaaggggcagagacccaaatgccttcttatagtctgagcttgggagaggaggaggaggtggaggatctggccgtgaagctcacctctggagactctgaatctcatccagagcctactgaccatgtccttcaggaaaagaagatggctctactgagcttgctgtgctctactctggtctcagaagtaaacatgaacaatacatctgaccccaccctggctgccatttttgaaatctgtcgtgaacttgccctcctggagcctgagtttatcctcaaggcatctttgtatgccaggcagcagctgaacgtccggaatgtggccaataacatcttggccattgctgctttcttgccggcgtgtcgcccccacctgcgacgatatttctgtgccattgtccagctgccttctgactggatccaggtggctgagctttaccagagcctggctgagggagataagaataagctggtgcccctgcccgcctgtctccgtactgccatgacggacaaatttgcccagtttgacgagtaccagctggctaagtacaaccctcggaagcaccgggccaagagacacccccgccggccaccccgctctccagggatggagcctccattttctcacagatgttttccaaggtacatagggtttctcagagaagagcagagaaagtttgagaaggccggtgatacagtgtcagagaaaaagaatcctccaaggttcaccctgaagaagctggttcagcgactgcacatccacaagcctgcccagcacgttcaagccctgctgggttacagatacccctccaacctacagctcttttctcgaagtcgccttcctgggccttgggattctagcagagctgggaagaggatgaagctgtctaggccagagacctgggagcgggagctgagcctacgggggaacaaagcgtcggtctgggaggaactcattgaaaatgggaagcttcccttcatggccatgcttcggaacctgtgcaacctgctgcgggttggaatcagttcccgccaccatgagctcattctccagagactccagcatgcgaagtcggtgatccacagtcggcagtttccattcagatttcttaacgcccatgatgccattgatgccctcgaggctcaactcagaaatcaagcattgccctttccttcgaatataacactgatgaggcggatactaactagaaatgaaaagaaccgtcccaggcggaggtttctttgccacctaagccgtcagcagcttcggatggcaatgaggatacctgtgttgtatgagcagctcaagagggagaagctgagagtacacaaggccagacagtggaaatatgatggtgagatgctgaacaggtaccgacaggccctagagacagctgtgaacctctctgtgaagcacagcctgcccctgctgccaggccgcactgtcttggtctatctgacagatgctaatgcagacaggctctgtccaaagagcaacccacaagggcccccgctgaactatgcactgctgttgattgggatgatgatcacgagggcggagcaggtggacgtcgtgctgtgtggaggtgacactctgaagactgcagtgcttaaggcagaagaaggcatcctgaagactgccatcaagctccaggctcaagtccaggagtttgatgaaaatgatggatggtccctgaatacttttgggaaatacctgctgtctctggctggccaaagggttcctgtggacagggtcatcctccttggccaaagcatggatgatggaatgataaatgtggccaaacagctttactggcagcgtgtgaattccaagtgcctctttgttggtatcctcctaagaagggtacaatacctgtcaacagatttgaatcccaatgatgtgacactctcaggctgtactgatgcgatactgaagttcattgcagagcatggggcctcccatcttctggaacatgtgggccaaatggacaaaatattcaagattccaccacccccaggaaagacaggggtccagtctctccggccactggaagaggacactccaagccccttggctcctgtttcccagcaaggatggcgcagcatccggcttttcatttcatccactttccgagacatgcatggggagcgggacctgctgctgaggtctgtgctgccagcactgcaggcccgagcggcccctcaccgtatcagccttcacggaatcgacctccgctggggcgtcactgaggaggagacccgtaggaacagacaactggaagtgtgccttggggaggtggagaacgcacagctgtttgtggggattctgggctcccgttatggatacattccccccagctacaaccttcctgaccatccacacttccactgggcccagcagtacccttcagggcgctctgtgacagagatggaggtgatgcagttcctgaaccggaaccaacgtctgcagccctctgcccaagctctcatctacttccgggattccagcttcctcagctctgtgccagatgcctggaaatctgactttgtttctgagtctgaagaggccgcacgtcggatctcagaactgaagagctacctaagcagacagaaagggatcacctgccgcagatacccctgtgagtgggggggtgtggcagctggccggccctatgttggcgggctggaggagtttgggcagttggttctgcaggatgtatggaatatgatccagaagctctacctgcagcctggggccctgctggagcagccagtgtccatcccagacgatgacttggtccaggccaccttccagcagctgcagaagccaccgagtcctgcccggccacgccttcttcaggacacagtgcaacggctgatgctgccccacggaaggctgagcctggtgacggggcagtcaggacagggcaagacagccttcctggcatctcttgtgtcagccctgcaggctcctgatggggccaaggtggcatcattagtcttcttccacttttctggggctcgtcctgaccagggtcttgccctcactctgctcagacgcctctgtacctatctgcgtggccaactaaaagagccaggtgccctccccagcacctaccgaagcctggtgtgggagctgcagcagaggctgctgcccaagtctgctgagtccctgcatcctggccagacccaggtcctgatcatcgatggggctgataggttagtggaccagaatgggcagctgatttcagactggatcccaaagaagcttccccggtgtgtacacctggtgctgagtgtgtctagtgatgcaggcctaggggagacccttgagcagagccagggtgcccacgtgctggccttggggcctctggaggcctctgctcgggcccggctggtgagagaggagctggccctgtacgggaagcggctggaggagtcaccatttaacaaccagatgcgactgctgctggtgaagcgggaatcaggccggccgctctacctgcgcttggtcaccgatcacctgaggctcttcacgctgtatgagcaggtgtctgagagactccggaccctgcctgccactgtccccctgctgctgcagcacatcctgagcacactggagaaggagcacgggcctgatgtccttccccaggccttgactgccctagaagtcacacggagtggtttgactgtggaccagctgcacggagtgctgagtgtgtggcggacactaccgaaggggactaagagctgggaagaagcagtggctgctggtaacagtggagacccctaccccatgggcccgtttgcctgcctcgtccagagtctgcgcagtttgctaggggagggccctctggagcgccctggtgcccggctgtgcctccctgatgggcccctgagaacagcagctaaacgttgctatgggaagaggccagggctagaggacacggcacacatcctcattgcagctcagctctggaagacatgtgacgctgatgcctcaggcaccttccgaagttgccctcctgaggctctgggagacctgccttaccacctgctccagagcgggaaccgtggacttctttcgaagttccttaccaacctccatgtggtggctgcacacttggaattgggtctggtctctcggctcttggaggcccatgccctctatgcttcttcagtccccaaagaggaacaaaagctccccgaggctgacgttgcagtgtttcgcaccttcctgaggcagcaggcttcaatcctcagccagtacccccggctcctgccccagcaggcagccaaccagcccctggactcacctctttgccaccaagcctcgctgctctcccggagatggcacctccaacacacactacgatggcttaataaaccccggaccatgaaaaatcagcaaagctccagcctgtctctggcagtttcctcatcccctactgctgtggccttctccaccaatgggcaaagagcagctgtgggcactgccaatgggacagtttacctgttggacctgagaacttggcaggaggagaagtctgtggtgagtggctgtgatggaatctctgcttgtttgttcctctccgatgatacactctttcttactgccttcgacgggctcctggagctctgggacctgcagcatggttgtcgggtgctgcagactaaggctcaccagtaccaaatcactggctgctgcctgagcccagactgccggctgctagccaccgtgtgcttgggaggatgcctaaagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggttcccagggggctcagggtcaggcactggatgtggcagtgtccgccctggcctggctaagccccaaggtattggtgagtggtgcagaagatgggtccttgcagggctgggcactcaaggaatgctcccttcagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttggtgtgccaaacccacaccctcctgggacacagcggcccagtccgtgctgctgctgtttcagaaacctcaggcctcatgctgaccgcctctgaggatggttctgtacggctctggcaggttcctaaggaagcagatgacacatgtataccaaggagttctgcagccgtcactgctgtggcttgggcaccagatggttccatggcagtatctggaaatcaagctggggaactaatcttgtggcaggaagctaaggctgtggccacagcacaggctccaggccacattggtgctctgatctggtcctcggcacacaccttttttgtcctcagtgctgatgagaaaatcagcgagtggcaagtgaaactgcggaagggttcggcacccggaaatttgagtcttcacctgaaccgaattctacaggaggacttaggggtgctgacaagtctggattgggctcctgatggtcactttctcatcttggccaaagcagatttgaagttactttgcatgaagccaggggatgctccatctgaaatctggagcagctatacagaaaatcctatgatattgtccacccacaaggagtatggcatatttgtcctgcagcccaaggatcctggagttctttctttcttgaggcaaaaggaatcaggagagtttgaagagaggctgaactttgatataaacttagagaatcctagtaggaccctaatatcgataactcaagccaaacctgaatctgagtcctcatttttgtgtgccagctctgatgggatcctatggaacctggccaaatgcagcccagaaggagaatggaccacaggtaacatgtggcagaaaaaagcaaacactccagaaacccaaactccagggacagacccatctacctgcagggaatctgatgccagcatggatagtgatgccagcatggatagtgagccaacaccacatctaaagacacggcagcgtagaaagattcactcgggctctgtcacagccctccatgtgctacctgagttgctggtgacagcttcgaaggacagagatgttaagctatgggagagacccagtatgcagctgctgggcctgttccgatgcgaagggtcagtgagctgcctggaaccttggctgggcgctaactccaccctgcagcttgccgtgggagacgtgcagggcaatgtgtactttctgaattgggaatgaagatgtgccactcgggaataatgataccccttgtgctagagatgcaaagcctgaagacactggtagcttttaataattataaaattaataatttcttgataattataaaaatgaagtgtcaaaaaatctcaagtgtaggcctgcctgtgttctcatgtggatttagaacaggaggatattctatgtgtatgtatatgtacattctaatgtgtgtctcttcttattcaacattaatccttactagaaccacaagaaagtgaatgaaatctttagtaggtactcttttgaaactaggttttagaattcttgcatcactcgcgggccctaggaccctaggatgccattcttgccaggaggaggaatgagagtgatgttggccaacattcaatttgaacagagcatggaagacctttcagttcatcgggaaagaatgagggagggagaataagtcagtcatgcatcagggcatttagaaagagctatgtttctgtcacagagacagcccttttctcagaactacccagaggaggccgggcatggtggctcacgcttgtaatcccagcactttgggaggccgaggtgggcagatcacgaggtcaggagatcaagaccatcctggctaacatagtgaaaccctgtctctactaaaaaatacaaaaagttagccaggtgtggcggcgggcacctgtagtcccagctacttgggaggctgaggcaggagaatggcgtgaacccaggaggcggagcttgcagtgagccgagacaccactgcactccagcctgggcaacagagcgagactctgtctaaaaaaaaaaaaaaagaactacccagatgagaggtgaggagccaagccattgaaagcggaacaaaccttctggttttcccaacttctgacacgactttcaactttagtcaatatggtaattggcattctcagaagagatcacgaaagtgtcttactctctctcaaattgaaattcacaaagattaaaactaattgagaggtggcacaatcatagccatgaactctgattttcttaagtaaaaaaccttttttttttttttttgtttttgagatagagtctggctctgtcacctaggctggagtgcaatggtgcaatctcagctcagtgcaacctctgcttcctgggttcaagcgattctcctgccttagcctcccgagtagctgggattacaggtgcccaccaccacgcccagctaatttttgtatttcagtagagacgaagtttcaccatgttggccaggtgggtctcaaactcctgacctcaggttatctgcacacctcagcctcttaaagttctgggattacaggcgtgagccattgtgcccggcccataaaagaactttattatatttctaaaattcaatcatatggaagaatctattgagcaggttagcctttgcttaactttcctcctctgttactccagccttagctggggtgttttgtagaattttcagagcatgggagacagacaactagagcttcctcctgcccttggcccatgcttttaggagagcaaaaggcaaaagattgaaaccactgactttagtttcctcaggccctttctttctgagggttaaagaagaaggaaatgtcttctgtggccaagaattcaaggacttgtaggagataagtgaaggctattacagggattttgtcctggtttggtaggtttctcttggagaaataccactacaccctggtctagaaatgagttttgaagacttggggagttaaagggcactgagttttactctcactgtaccctgattccaggttttacatggagaaataacctgagggactttatttctatccaatgccctggtttccatcctgaccagaggatgatgacatccgctgataggccatgcttctgtcttctcttatgtgcctcatgccaagcctcgaaatataccttctggaccatcatttccacatctaccttgtgactagaagtcctagttatggtattttgaaatttatgatccataatccttgccagaaatcctgcagcgaactatggcatggcatcatcctagtcattgatttcaatcttttgccttttgctcccctaaaatcttgggccaattgcaggaggaagctctatttgtctctcttccatgctctgaaaattatataaaagcatcccagctaaggctggagtgaaggggttggggaaagttaagcaaaggctaacttgaccaataggctcaatagattcagtcttgttggccaggcccacttgaagggttttttgtttcatcttggagaaggacagtgaggtcatggtataattgttatgagtaaagtcaagaacagcttctaggtaaaagtaattatgtacccaaaaggagttgaagggaaaatcaatttaggtttacattaaacatccttcaagttcttatctttaaatggagtttcagtgtctcccaaaggctggatgagttttacagttataaccactggattgtgagaccataggacatttgaacaatcttttcttctacccatctagaaaagcatcttttttatataccaaatttttacacatatatccacatctgtttttgaaatctagagcagaggtactcaaagtttggttcatggactagtgccagttcacaaattgttaatgttttataatgagataagtacggaagttgagagtaaccatttagaaactgtgtaggaatttaaaaagtaatatctgacaaatttaataataaaaatggaggcttgta

SEQ ID NO: 190013 - DNA, 2967 bp, Homo sapiens
  Payload ID: 17523
  Gene Symbol: TEP1
  Gene Name: telomerase-associated protein 1
  ENST ID: ENST00000553365
  CDS Start-End: 1-753
tgggcaccagatggttccatggcagtatctggaaatcaagctggggaactaatcttgtggcaggaagctaaggctgtggccacagcacaggctccaggccacattggtgctctgatctggtcctcggcacacaccttttttgtcctcagtgctgatgagaaaatcagcgagtggcaagtgaaactgcggaagggttcggcacccggaaatttgagtcttcacctgaaccgaattctacaggaggacttaggggtgctgacaagtctggattgggctcctgatggtcactttctcatcttggccaaagcagatttgaagttactttgcatgaagccaggggatgctccatctgaaatctggagcagctatacagaaaatcctatgatattgtccacccacaaggagtatggcatatttgtcctgcagcccaaggatcctggagttctttctttcttgaggcaaaaggaatcaggagagtttgaagagaggctgaactttgatataaacttagagaatcctagtaggaccctaatatcgataactcaagccaaacctgaatctgctctgatgggatcctatggaacctggccaaatgcagcccagaaggagaatggaccacaggtaacatgtggcagaaaaaagcaaacactccagaaacccaaactccagggacagacccatctacctgcagggaatctgatgccagcatggatagtgatgccagcatggatagtgagccaacaccacatctaaagacacggcagcgtagaaagattcactcgggctctgtcacagccctccatgtgctacctgagttgctggtgacagcttcgaaggacagagatgttaagctatgggagagacccagtatgcagctgctgggcctgttccgatgcgaagggtcagtgagctgcctggaaccttggctgggcgctaactccaccctgcagcttgccgtgggagacgtgcagggcaatgtgtactttctgaattgggaatgaagatgtgccactcgggaataatgataccccttgtgctagagatgcaaagcctgaagacactggtagcttttaataattataaaattaataatttcttgataattataaaaatgaagtgtcaaaaaatctcaagtgtaggcctgcctgtgttctcatgtggatttagaacaggaggatattctatgtgtatgtatatgtacattctaatgtgtgtctcttcttattcaacattaatccttactagaaccacaagaaagtgaatgaaatctttagtaggtactcttttgaaactaggttttagaattcttgcatcactcgcgggccctaggaccctaggatgccattcttgccaggaggaggaatgagagtgatgttggccaacattcaatttgaacagagcatggaagacctttcagttcatcgggaaagaatgagggagggagaataagtcagtcatgcatcagggcatttagaaagagctatgtttctgtcacagagacagcccttttctcagaactacccagaggaggcgtgagccattgtgcccggcccataaaagaactttattatatttctaaaattcaatcatatggaagaatctattgagcaggttagcctttgcttaactttcctcctctgttactccagccttagctggggtgttttgtagaattttcagagcatgggagacagacaactagagcttcctcctgcccttggcccatgcttttaggagagcaaaaggcaaaagattgaaaccactgactttagtttcctcaggccctttctttctgagggttaaagaagaaggaaatgtcttctgtggccaagaattcaaggacttgtaggagataagtgaaggctattacagggattttgtcctggtttggtaggtttctcttggagaaataccactacaccctggtctagaaatgagttttgaagacttggggagttaaagggcactgagttttactctcactgtaccctgattccaggttttacatggagaaataacctgagggactttatttctatccaatgccctggtttccatcctgaccagaggatgatgacatccgctgataggccatgcttctgtcttctcttatgtgcctcatgccaagcctcgaaatataccttctggaccatcatttccacatctaccttgtgactagaagtcctagttatggtattttgaaatttatgatccataatccttgccagaaatcctgcagcgaactatggcatggcatcatcctagtcattgatttcaatcttttgccttttgctcccctaaaatcttgggccaattgcaggaggaagctctatttgtctctcttccatgctctgaaaattatataaaagcatcccagctaaggctggagtgaaggggttggggaaagttaagcaaaggctaacttgaccaataggctcaatagattcagtcttgttggccaggcccacttgaagggttttttgtttcatcttggagaaggacagtgaggtcatggtataattgttatgagtaaagtcaagaacagcttctaggtaaaagtaattatgtacccaaaaggagttgaagggaaaatcaatttaggtttacattaaacatccttcaagttcttatctttaaatggagtttcagtgtctcccaaaggctggatgagttttacagttataaccactggattgtgagaccataggacatttgaacaatcttttcttctacccatctagaaaagcatcttttttatataccaaatttttacacatatatccacatctgtttttgaaatctagagcagaggtactcaaagtttggttcatggactagtgccagttcacaaattgttaatgttttataatgagataagtacggaagttgagagtaaccatttagaaactgtgtaggaatttaaaaagtaatatctgacaaatttaataataaaaatggaggcttgta

SEQ ID NO: 190014 - DNA, 602 bp, Homo sapiens
  Payload ID: 17523
  Gene Symbol: TEP1
  Gene Name: telomerase-associated protein 1
  ENST ID: ENST00000553984
  CDS Start-End: 1-602
ggcagtatctggaaatcaagctggggaactaatcttgtggcaggaagctaaggctgtggccacagcacaggaggacttaggggtgctgacaagtctggattgggctcctgatggtcactttctcatcttggccaaagcagatttgaagttactttgcatgaagccaggggatgctccatctgaaatctggagcagctatacagaaaatcctatgatattgtccacccacaaggagtatggcatatttgtcctgcagcccaaggatcctggagttctttctttcttgaggcaaaaggaatcaggagagtttgaagagaggctgaactttgatataaacttagagaatcctagtaggaccctaatatcgataactcaagccaaacctgaatctgagtcctcatttttgtgtgccagctctgatgggatcctatggaacctggccaaatgcagcccagaaggagaatggaccacaggtaacatgtggcagaaaaaagcaaacactccagaaacccaaactccagggacagacccatctacctgcagggaatctgatgccagcatggatagtgatgccagcatggatagtgagccaacaccacatc

SEQ ID NO: 190015 - DNA, 6697 bp, Homo sapiens
  Payload ID: 17523
  Gene Symbol: TEP1
  Gene Name: telomerase-associated protein 1
  ENST ID: ENST00000555008
  CDS Start-End: 1-5715
atgctgaacaggtaccgacaggccctagagacagctgtgaacctctctgtgaagcacagcctgcccctgctgccaggccgcactgtcttggtctatctgacagatgctaatgcagacaggctctgtccaaagagcaacccacaagggcccccgctgaactatgcactgctgttgattgggatgatgatcacgagggcggagcaggtggacgtcgtgctgtgtggaggtgacactctgaagactgcagtgcttaaggcagaagaaggcatcctgaagactgccatcaagctccaggctcaagtccaggagtttgatgaaaatgatggatggtccctgaatacttttgggaaatacctgctgtctctggctggccaaagggttcctgtggacagggtcatcctccttggccaaagcatggatgatggaatgataaatgtggccaaacagctttactggcagcgtgtgaattccaagtgcctctttgttggtatcctcctaagaagggtacaatacctgtcaacagatttgaatcccaatgatgtgacactctcaggctgtactgatgcgatactgaagttcattgcagagcatggggcctcccatcttctggaacatgtgggccaaatggacaaaatattcaagattccaccacccccaggaaagacaggggtccagtctctccggccactggaagaggacactccaagccccttggctcctgtttcccagcaaggatggcgcagcatccggcttttcatttcatccactttccgagacatgcatggggagcgggacctgctgctgaggtctgtgctgccagcactgcaggcccgagcggcccctcaccgtatcagccttcacggaatcgacctccgctggggcgtcactgaggaggagacccgtaggaacagacaactggaagtgtgccttggggaggtggagaacgcacagctgtttgtggggattctgggctcccgttatggatacattccccccagctacaaccttcctgaccatccacacttccactgggcccagcagtacccttcagggcgctctgtgacagagatggaggtgatgcagttcctgaaccggaaccaacgtctgcagccctctgcccaagctctcatctacttccgggattccagcttcctcagctctgtgccagatgcctggaaatctgactttgtttctgagtctgaagaggccgcacgtcggatctcagaactgaagagctacctaagcagacagaaagggatcacctgccgcagatacccctgtgagtgggggggtgtggcagctggccggccctatgttggcgggctggaggagtttgggcagttggttctgcaggatgtatggaatatgatccagaagctctacctgcagcctggggccctgctggagcagccagtgtccatcccagacgatgacttggtccaggccaccttccagcagctgcagaagccaccgagtcctgcccggccacgccttcttcaggacacagtgcaacggctgatgctgccccacggaaggctgagcctggtgacggggcagtcaggacagggcaagacagccttcctggcatctcttgtgtcagccctgcaggctcctgatggggccaaggtggcatcattagtcttcttccacttttctggggctcgtcctgaccagggtcttgccctcactctgctcagacgcctctgtacctatctgcgtggccaactaaaagagccaggtgccctccccagcacctaccgaagcctggtgtgggagctgcagcagaggctgctgcccaagtctgctgagtccctgcatcctggccagacccaggtcctgatcatcgatggggctgataggttagtggaccagaatgggcagctgatttcagactggatcccaaagaagcttccccggtgtgtacacctggtgctgagtgtgtctagtgatgcaggcctaggggagacccttgagcagagccagggtgcccacgtgctggccttggggcctctggaggcctctgctcgggcccggctggtgagagaggagctggccctgtacgggaagcggctggaggagtcaccatttaacaaccagcgggaatcaggccggccgctctacctgcgcttggtcaccgatcacctgaggctcttcacgctgtatgagcaggtgtctgagagactccggaccctgcctgccactgtccccctgctgctgcagcacatcctgagcacactggagaaggagcacgggcctgatgtccttccccaggccttgactgccctagaagtcacacggagtggtttgactgtggaccagctgcacggagtgctgagtgtgtggcggacactaccgaaggggactaagagctgggaagaagcagtggctgctggtaacagtggagacccctaccccatgggcccgtttgcctgcctcgtccagagtctgcgcagtttgctaggggagggccctctggagcgccctggtgcccggctgtgcctccctgatgggcccctgagaacagcagctaaacgttgctatgggaagaggccagggctagaggacacggcacacatcctcattgcagctcagctctggaagacatgtgacgctgatgcctcaggcaccttccgaagttgccctcctgaggctctgggagacctgccttaccacctgctccagagcgggaaccgtggacttctttcgaagttccttaccaacctccatgtggtggctgcacacttggaattgggtctggtctctcggctcttggaggcccatgccctctatgcttcttcagtccccaaagaggaacaaaagctccccgaggctgacgttgcagtgtttcgcaccttcctgaggcagcaggcttcaatcctcagccagtacccccggctcctgccccagcaggcagccaaccagcccctggactcacctctttgccaccaagcctcgctgctctcccggagatggcacctccaacacacactacgatggcttaataaaccccggaccatgaaaaatcagcaaagctccagcctgtctctggcagtttcctcatcccctactgctgtggccttctccaccaatgggcaaagagcagctgtgggcactgccaatgggacagtttacctgttggacctgagaacttggcaggaggagaagtctgtggtgagtggctgtgatggaatctctgcttgtttgttcctctccgatgatacactctttcttactgccttcgacgggctcctggagctctgggacctgcagcatggttgtcgggtgctgcagactaaggctcaccagtaccaaatcactggctgctgcctgagcccagactgccggctgctagccaccgtgtgcttgggaggatgcctaaagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggttcccagggggctcagggtcaggcactggatgtggcagtgtccgccctggcctggctaagccccaaggtattggtgagtggtgcagaagatgggtccttgcagggctgggcactcaaggaatgctcccttcagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttggtgtgccaaacccacaccctcctgggacacagcggcccagtccgtgctgctgctgtttcagaaacctcaggcctcatgctgaccgcctctgaggatggttctgtacggctctggcaggttcctaaggaagcagatgacacatgtataccaaggagttctgcagccgtcactgctgtggcttgggcaccagatggttccatggcagtatctggaaatcaagctggggaactaatcttgtggcaggaagctaaggctgtggccacagcacaggctccaggccacattggtgctctgatctggtcctcggcacacaccttttttgtcctcagtgctgatgagaaaatcagcgagtggcaagtgaaactgcggaagggttcggcacccggaaatttgagtcttcacctgaaccgaattctacaggaggacttaggggtgctgacaagtctggattgggctcctgatggtcactttctcatcttggccaaagcagatttgaagttactttgcatgaagccaggggatgctccatctgaaatctggagcagctatacagaaaatcctatgatattgtccacccacaaggagtatggcatatttgtcctgcagcccaaggatcctggagttctttctttcttgaggcaaaaggaatcaggagagtttgaagagaggctgaactttgatataaacttagagaatcctagtaggaccctaatatcgataactcaagccaaacctgaatctgagtcctcatttttgtgtgccagctctgatgggatcctatggaacctggccaaatgcagcccagaaggagaatggaccacaggtaacatgtggcagaaaaaagcaaacactccagaaacccaaactccagggacagacccatctacctgcagggaatctgatgccagcatggatagtgatgccagcatggatagtgagccaacaccacatctaaagacacggcagcgtagaaagccctccatgtgctacctgagttgctggtgacagcttcgaaggacagagatgttaagctatgggagagacccagtatgcagctgctgggcctgttccgatgcgaagggtcagtgagctgcctggaaccttggctgggcgctaactccaccctgcagcttgccgtgggagacgtgcagggcaatgtgtactttctgaattgggaatgaagatgtgccactcgggaataatgataccccttgtgctagagatgcaaagcctgaagacactggtagcttttaataattataaaattaataatttcttgataattataaaaatgaagtgtcaaaaaatctcaagtgtaggcctgcctgtgttctcatgtggatttagaacaggaggatattctatgtgtatgtatatgtacattctaatgtgtgtctcttcttattcaacattaatccttactagaaccacaagaaagtgaatgaaatctttagtaggtactcttttgaaactaggttttagaattcttgcatcactcgcgggccctaggaccctaggatgccattcttgccaggaggaggaatgagagtgatgttggccaacattcaatttgaacagagcatggaagacctttcagttcatcgggaaagaatgagggagggagaataagtcagtcatgcatcagggcatttagaaagagctatgtttctgtcacagagacagcccttttctcagaactacccagaggaggccgggcatggtggctcacgcttgtaatcccagcactttgggaggccgaggtgggcagatcacgaggtcaggagatcaagaccatcctggctaacatagtgaaaccctgtctctactaaaaaatacaaaaagttagccaggtgtggcggcgggcacctgtagtcccagctacttgggaggctgaggcaggagaatggcgtgaacccaggaggcggagcttgcagtgagccgagacaccactgcactccagcctgggcaacagagcgagactctgtct

SEQ ID NO: 190016 - DNA, 2698 bp, Homo sapiens
  Payload ID: 17523
  Gene Symbol: TEP1
  Gene Name: telomerase-associated protein 1
  ENST ID: ENST00000557314
  CDS Start-End: 1-212
ttccccaggccttgactgccctagaagtcacacggagtggtttgactgtggaccagctgcacggagtgctgagtgtgtggcggacactaccgaaggggactaagagctgggaagaagcagtggctgctggtaacagtggagacccctaccccatgggcccgtttgcctgcctcgtccagagtctgcgcagctcagctctggaagacatgtgacgctgatgcctcaggcaccttccgaagttgccctcctgaggctctgggagacctgccttaccacctgctccagagcgggaaccgtggacttctttcgaagttccttaccaacctccatgtggtggctgcacacttggaattgggtctggtctctcggctcttggaggcccatgccctctatgcttcttcagtccccaaagaggaacaaaagctccccgaggctgacgttgcagtgtttcgcaccttcctgaggcagcaggcttcaatcctcagccagtacccccggctcctgccccagcaggcagccaaccagcccctggactcacctctttgccaccaagcctcgctgctctcccggagatggcacctccaacacacactacgatggcttaataaaccccggaccatgaaaaatcagcaaagctccagcctgtctctggcagtttcctcatcccctactgctgtggccttctccaccaatgggcaaagagcagctgtgggcactgccaatgggacagtttacctgttggacctgagaacttggcaggaggagaagtctgtggtgagtggctgtgatggaatctctgcttgtttgttcctctccgatgatacactctttcttactgccttcgacgggctcctggagctctgggacctgcagcatggttgtcgggtgctgcagactaaggctcaccagtaccaaatcactggctgctgcctgagcccagactgccggctgctagccaccgtgtgcttgggaggatgcctaaagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggttcccagggggctcagggtcaggcactggatgtggcagtgtccgccctggcctggctaagccccaaggtattggtgagtggtgcagaagatgggtccttgcagggctgggcactcaaggaatgctcccttcagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttggtgtgccaaacccacaccctcctgggacacagcggcccagtccgtgctgctgctgtttcagaaacctcaggcctcatgctgaccgcctctgaggatggttctgtacggctctggcaggttcctaaggaagcagatgacacatgtataccaaggagttctgcagccgtcactgctgtggcttgggcaccagatggttccatggcagtatctggaaatcaagctggggaactaatcttgtggcaggaagctaaggctgtggccacagcacagtcttcacctgaaccgaattctacaggaggacttaggggtgctgacaagtctggattgggctcctgatggtcactttctcatcttggccaaagcagatttgaagttactttgcatg

SEQ ID NO: 190017 - DNA, 1055 bp, Homo sapiens
  Payload ID: 17523
  Gene Symbol: TEP1
  Gene Name: telomerase-associated protein 1
  ENST ID: ENST00000556488
  CDS Start-End: 1-309
cgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaagatggtgatcgggtggctgttggatatcgagcggatggcattaggatctacaaaatctcttcaggttcccagggggctcagggtcaggcactggatgtggcagtgtccgccctggcctggctaagccccaaggtattggtgagtggtgcagaagatgggtccttgcagggctgggcactcaaggaatgctcccttcagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttg

SEQ ID NO: 190018 - DNA, 7832 bp, Homo sapiens
  Payload ID: 17523
  Gene Symbol: TEP1
  Gene Name: telomerase-associated protein 1
  ENST ID: ENST00000555727
  CDS Start-End: 40-4485
aatcggacgccccaggcatatacaagctgagtttcagccatggaaaaactccatgggcatgtgtctgcccatccagacatcctctccttggagaaccggtgcctggctatgctccctgacttacagcccttggagaaactacatcagcatgtatctacccactcagatatcctctccttgaagaaccagtgcctagccacgcttcctgacctgaagaccatggaaaaaccacatggatatgtgtctgcccacccagacatcctctccttggagaaccagtgcctggccacactttctgacctgaagaccatggagaaaccacatggacatgtttctgcccacccagacatcctctccttggagaaccggtgcctggccaccctctctagtctaaagagcactgtgtctgccagccccttgttccagagtctacagatatctcacatgacgcaagctgatttgtaccgtgtgaacaacagcaattgcctgctctctgagcctccaagttggagggctcagcatttctctaagggactagacctttcaacctgccctatagccctgaaatccatctctgccacagagacagctcaggaagcaactttgggtcgttggtttgattcagaagagaagaaaggggcagagacccaaatgccttcttatagtctgagcttgggagaggaggaggaggtggaggatctggccgtgaagctcacctctggagactctgaatctcatccagagcctactgaccatgtccttcaggaaaagaagatggctctactgagcttgctgtgctctactctggtctcagaagtaaacatgaacaatacatctgaccccaccctggctgccatttttgaaatctgtcgtgaacttgccctcctggagcctgagtttatcctcaaggcatctttgtatgccaggcagcagctgaacgtccggaatgtggccaataacatcttggccattgctgctttcttgccggcgtgtcgcccccacctgcgacgatatttctgtgccattgtccagctgccttctgactggatccaggtggctgagctttaccagagcctggctgagggagataagaataagctggtgcccctgcccgcctgtctccgtactgccatgacggacaaatttgcccagtttgacgagtaccagctggctaagtacaaccctcggaagcaccgggccaagagacacccccgccggccaccccgctctccagggatggagcctccattttctcacagatgttttccaaggtacatagggtttctcagagaagagcagagaaagtttgagaaggccggtgatacagtgtcagagaaaaagaatcctccaaggttcaccctgaagaagctggttcagcgactgcacatccacaagcctgcccagcacgttcaagccctgctgggttacagatacccctccaacctacagctcttttctcgaagtcgccttcctgggccttgggattctagcagagctgggaagaggatgaagctgtctaggccagagacctgggagcgggagctgagcctacgggggaacaaagcgtcggtctgggaggaactcattgaaaatgggaagcttcccttcatggccatgcttcggaacctgtgcaacctgctgcgggttggaatcagttcccgccaccatgagctcattctccagagactccagcatgcgaagtcggtgatccacagtcggcagtttccattcagatttcttaacgcccatgatgccattgatgccctcgaggctcaactcagaaatcaagcattgccctttccttcgaatataacactgatgaggcggatactaactagaaatgaaaagaaccgtcccaggcggaggtttctttgccacctaagccgtcagcagcttcggatggcaatgaggatacctgtgttgtatgagcagctcaagagggagaagctgagagtacacaaggccagacagtggaaatatgatggtgagatgctgaacaggtaccgacaggccctagagacagctgtgaacctctctgtgaagcacagcctgcccctgctgccaggccgcactgtcttggtctatctgacagatgctaatgcagacaggctctgtccaaagagcaacccacaagggcccccgctgaactatgcactgctgttgattgggatgatgatcacgagggcggagcaggtggacgtcgtgctgtgtggaggtgacactctgaagactgcagtgcttaaggcagaagaaggcatcctgaagactgccatcaagctccaggctcaagtccaggagtttgatgaaaatgatggatggtccctgaatacttttgggaaatacctgctgtctctggctggccaaagggttcctgtggacagggtcatcctccttggccaaagcatggatgatggaatgataaatgtggccaaacagctttactggcagcgtgtgaattccaagtgcctctttgttggtatcctcctaagaagggtacaatacctgtcaacagatttgaatcccaatgatgtgacactctcaggctgtactgatgcgatactgaagttcattgcagagcatggggcctcccatcttctggaacatgtgggccaaatggacaaaatattcaagattccaccacccccaggaaagacaggggtccagtctctccggccactggaagaggacactccaagccccttggctcctgtttcccagcaaggatggcgcagcatccggcttttcatttcatccactttccgagacatgcatggggagcgggacctgctgctgaggtctgtgctgccagcactgcaggcccgagcggcccctcaccgtatcagccttcacggaatcgacctccgctggggcgtcactgaggaggagacccgtaggaacagacaactggaagtgtgccttggggaggtggagaacgcacagctgtttgtggggattctgggctcccgttatggatacattccccccagctacaaccttcctgaccatccacacttccactgggcccagcagtacccttcagggcgctctgtgacagagatggaggtgatgcagttcctgaaccggaaccaacgtctgcagccctctgcccaagctctcatctacttccgggattccagcttcctcagctctgtgccagatgcctggaaatctgactttgtttctgagtctgaagaggccgcacgtcggatctcagaactgaagagctacctaagcagacagaaagggatcacctgccgcagatacccctgtgagtgggggggtgtggcagctggccggccctatgttggcgggctggaggagtttgggcagttggttctgcaggatgtatggaatatgatccagaagctctacctgcagcctggggccctgctggagcagccagtgtccatcccagacgatgacttggtccaggccaccttccagcagctgcagaagccaccgagtcctgcccggccacgccttcttcaggacacagtgcaacggctgatgctgccccacggaaggctgagcctggtgacggggcagtcaggacagggcaagacagccttcctggcatctcttgtgtcagccctgcaggctcctgatggggccaaggtggcatcattagtcttcttccacttttctggggctcgtcctgaccagggtcttgccctcactctgctcagacgcctctgtacctatctgcgtggccaactaaaagagccaggtgccctccccagcacctaccgaagcctggtgtgggagctgcagcagaggctgctgcccaagtctgctgagtccctgcatcctggccagacccaggtcctgatcatcgatggggctgataggttagtggaccagaatgggcagctgatttcagactggatcccaaagaagcttccccggtgtgtacacctggtgctgagtgtgtctagtgatgcaggcctaggggagacccttgagcagagccagggtgcccacgtgctggccttggggcctctggaggcctctgctcgggcccggctggtgagagaggagctggccctgtacgggaagcggctggaggagtcaccatttaacaaccagatgcgactgctgctggtgaagcgggaatcaggccggccgctctacctgcgcttggtcaccgatcacctgaggctcttcacgctgtatgagcaggtgtctgagagactccggaccctgcctgccactgtccccctgctgctgcagcacatcctgagcacactggagaaggagcacgggcctgatgtccttccccaggccttgactgccctagaagtcacacggagtggtttgactgtggaccagctgcacggagtgctgagtgtgtggcggacactaccgaaggggactaagagctgggaagaagcagtggctgctggtaacagtggagacccctaccccatgggcccgtttgcctgcctcgtccagagtctgcgcagctcagctctggaagacatgtgacgctgatgcctcaggcaccttccgaagttgccctcctgaggctctgggagacctgccttaccacctgctccagagcgggaaccgtggacttctttcgaagttccttaccaacctccatgtggtggctgcacacttggaattgggtctggtctctcggctcttggaggcccatgccctctatgcttcttcagtccccaaagaggaacaaaagctccccgaggctgacgttgcagtgtttcgcaccttcctgaggcagcaggcttcaatcctcagccagtacccccggctcctgccccagcaggcagccaaccagcccctggactcacctctttgccaccaagcctcgctgctctcccggagatggcacctccaacacacactacgatggcttaataaaccccggaccatgaaaaatcagcaaagctccagcctgtctctggcagtttcctcatcccctactgctgtggccttctccaccaatgggcaaagagcagctgtgggcactgccaatgggacagtttacctgttggacctgagaacttggcaggaggagaagtctgtggtgagtggctgtgatggaatctctgcttgtttgttcctctccgatgatacactctttcttactgccttcgacgggctcctggagctctgggacctgcagcatggttgtcgggtgctgcagactaaggctcaccagtaccaaatcactggctgctgcctgagcccagactgccggctgctagccaccgtgtgcttgggaggatgcctaaagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggttcccagggggctcagggtcaggcactggatgtggcagtgtccgccctggcctggctaagccccaaggtattggtgagtggtgcagaagatgggtccttgcagggctgggcactcaaggaatgctcccttcagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttggtgtgccaaacccacaccctcctgggacacagcggcccagtccgtgctgctgctgtttcagaaacctcaggcctcatgctgaccgcctctgaggatggttctgtacggctctggcaggttcctaaggaagcagatgacacatgtataccaaggagttctgcagccgtcactgctgtggcttgggcaccagatggttccatggcagtatctggaaatcaagctggggaactaatcttgtggcaggaagctaaggctgtggccacagcacaggctccaggccacattggtgctctgatctggtcctcggcacacaccttttttgtcctcagtgctgatgagaaaatcagcgagtggcaagtgaaactgcggaagggttcggcacccggaaatttgagtcttcacctgaaccgaattctacaggaggacttaggggtgctgacaagtctggattgggctcctgatggtcactttctcatcttggccaaagcagatttgaagttactttgcatgaagccaggggatgctccatctgaaatctggagcagctatacagaaaatcctatgatattgtccacccacaaggagtatggcatatttgtcctgcagcccaaggatcctggagttctttctttcttgaggcaaaaggaatcaggagagtttgaagagaggctgaactttgatataaacttagagaatcctagtaggaccctaatatcgataactcaagccaaacctgaatctgagtcctcatttttgtgtgccagctctgatgggatcctatggaacctggccaaatgcagcccagaaggagaatggaccacaggtaacatgtggcagaaaaaagcaaacactccagaaacccaaactccagggacagacccatctacctgcagggaatctgatgccagcatggatagtgatgccagcatggatagtgagccaacaccacatctaaagacacggcagcgtagaaagattcactcgggctctgtcacagccctccatgtgctacctgagttgctggtgacagcttcgaaggacagagatgttaagctatgggagagacccagtatgcagctgctgggcctgttccgatgcgaagggtcagtgagctgcctggaaccttggctgggcgctaactccaccctgcagcttgccgtgggagacgtgcagggcaatgtgtactttctgaattgggaatgaagatgtgccactcgggaataatgataccccttgtgctagagat

SEQ ID NO: 190019 - DNA, 732 bp, Homo sapiens
  Payload ID: 17523
  Gene Symbol: TEP1
  Gene Name: telomerase-associated protein 1
  ENST ID: ENST00000471684
  CDS Start-End: 1-235
acggctggagaggatggcaaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggttcccagggggctcagggtcaggcactggatgtggcagtgtccgccctggcctggctaagccccaagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgg

SEQ ID NO: 190020 - DNA, 581 bp, Homo sapiens
  Payload ID: 17523
  Gene Symbol: TEP1
  Gene Name: telomerase-associated protein 1
  ENST ID: ENST00000556549
  CDS Start-End: 84-581
ctgctgcgggaatcggacgccccaggtcaggcacccagggtttccagccccagtctaaggcatatacaagctgagtttcagccatggaaaaactccatgggcatgtgtctgcccatccagacatcctctccttggagaaccggtgcctggctatgctccctgacttacagcccttggagaaactacatcagcatgtatctacccactcagatatcctctccttgaagaaccagtgcctagccacgcttcctgacctgaagaccatggaaaaaccacatggatatgtgtctgcccacccagacatcctctccttggagaaccagtgcctggccacactttctgacctgaagaccatggagaaaccacatggacatgtttctgcccacccagacatcctctccttggagaaccggtgcctggccaccctctctagtctaaagagcactgtgtctgccagccccttgttccagagtctacagatatctcacatgacgcaagctgatttgtaccgtgtgaacaacagcaattgcctgctctctgagcctccaagttggagggctcagcatttctctaagggacta

SEQ ID NO: 190021 - DNA, 7643 bp, Homo sapiens
  Payload ID: 17523
  Gene Symbol: TEP1
  Gene Name: telomerase-associated protein 1
  ENST ID: ENST00000556935
  CDS Start-End: 41-7600
gaatcggacgccccaggcatatacaagctgagtttcagccatggaaaaactccatgggcatgtgtctgcccatccagacatcctctccttggagaaccggtgcctggctatgctccctgacttacagcccttggagaaactacatcagcatgtatctacccactcagatatcctctccttgaagaaccagtgcctagccacgcttcctgacctgaagaccatggaaaaaccacatggatatgtgtctgcccacccagacatcctctccttggagaaccagtgcctggccacactttctgacctgaagaccatggagaaaccacatggacatgtttctgcccacccagacatcctctccttggagaaccggtgcctggccaccctctctagtctaaagagcactgtgtctgccagccccttgttccagagtctacagatatctcacatgacgcaagctgatttgtaccgtgtgaacaacagcaattgcctgctctctgagcctccaagttggagggctcagcatttctctaagggactagacctttcaacctgccctatagccctgaaatccatctctgccacagagacagctcaggaagcaactttgggtcgttggtttgattcagaagagaagaaaggggcagagacccaaatgccttcttatagtctgagcttgggagaggaggaggaggtggaggatctggccgtgaagctcacctctggagactctgaatctcatccagagcctactgaccatgtccttcaggaaaagaagatggctctactgagcttgctgtgctctactctggtctcagaagtaaacatgaacaatacatctgaccccaccctggctgccatttttgaaatctgtcgtgaacttgccctcctggagcctgagtttatcctcaaggggatggagcctccattttctcacagatgttttccaaggtacatagggtttctcagagaagagcagagaaagtttgagaaggccggtgatacagtgtcagagaaaaagaatcctccaaggttcaccctgaagaagctggttcagcgactgcacatccacaagcctgcccagcacgttcaagccctgctgggttacagatacccctccaacctacagctcttttctcgaagtcgccttcctgggccttgggattctagcagagctgggaagaggatgaagctgtctaggccagagacctgggagcgggagctgagcctacgggggaacaaagcgtcggtctgggaggaactcattgaaaatgggaagcttcccttcatggccatgcttcggaacctgtgcaacctgctgcgggttggaatcagttcccgccaccatgagctcattctccagagactccagcatgcgaagtcggtgatccacagtcggcagtttccattcagatttcttaacgcccatgatgccattgatgccctcgaggctcaactcagaaatcaagcattgccctttccttcgaatataacactgatgaggcggatactaactagaaatgaaaagaaccgtcccaggcggaggtttctttgccacctaagccgtcagcagcttcggatggcaatgaggatacctgtgttgtatgagcagctcaagagggagaagctgagagtacacaaggccagacagtggaaatatgatggtgagatgctgaacaggtaccgacaggccctagagacagctgtgaacctctctgtgaagcacagcctgcccctgctgccaggccgcactgtcttggtctatctgacagatgctaatgcagacaggctctgtccaaagagcaacccacaagggcccccgctgaactatgcactgctgttgattgggatgatgatcacgagggcggagcaggtggacgtcgtgctgtgtggaggtgacactctgaagactgcagtgcttaaggcagaagaaggcatcctgaagactgccatcaagctccaggctcaagtccaggagtttgatgaaaatgatggatggtccctgaatacttttgggaaatacctgctgtctctggctggccaaagggttcctgtggacagggtcatcctccttggccaaagcatggatgatggaatgataaatgtggccaaacagctttactggcagcgtgtgaattccaagtgcctctttgttggtatcctcctaagaagggtacaatacctgtcaacagatttgaatcccaatgatgtgacactctcaggctgtactgatgcgatactgaagttcattgcagagcatggggcctcccatcttctggaacatgtgggccaaatggacaaaatattcaagattccaccacccccaggaaagacaggggtccagtctctccggccactggaagaggacactccaagccccttggctcctgtttcccagcaaggatggcgcagcatccggcttttcatttcatccactttccgagacatgcatggggagcgggacctgctgctgaggtctgtgctgccagcactgcaggcccgagcggcccctcaccgtatcagccttcacggaatcgacctccgctggggcgtcactgaggaggagacccgtaggaacagacaactggaagtgtgccttggggaggtggagaacgcacagctgtttgtggggattctgggctcccgttatggatacattccccccagctacaaccttcctgaccatccacacttccactgggcccagcagtacccttcagggcgctctgtgacagagatggaggtgatgcagttcctgaaccggaaccaacgtctgcagccctctgcccaagctctcatctacttccgggattccagcttcctcagctctgtgccagatgcctggaaatctgactttgtttctgagtctgaagaggccgcacgtcggatctcagaactgaagagctacctaagcagacagaaagggatcacctgccgcagatacccctgtgagtgggggggtgtggcagctggccggccctatgttggcgggctggaggagtttgggcagttggttctgcaggatgtatggaatatgatccagaagctctacctgcagcctggggccctgctggagcagccagtgtccatcccagacgatgacttggtccaggccaccttccagcagctgcagaagccaccgagtcctgcccggccacgccttcttcaggacacagtgcaacggctgatgctgccccacggaaggctgagcctggtgacggggcagtcaggacagggcaagacagccttcctggcatctcttgtgtcagccctgcaggctcctgatggggccaaggtggcatcattagtcttcttccacttttctggggctcgtcctgaccagggtcttgccctcactctgctcagacgcctctgtacctatctgcgtggccaactaaaagagccaggtgccctccccagcacctaccgaagcctggtgtgggagctgcagcagaggctgctgcccaagtctgctgagtccctgcatcctggccagacccaggtcctgatcatcgatggggctgataggttagtggaccagaatgggcagctgatttcagactggatcccaaagaagcttccccggtgtgtacacctggtgctgagtgtgtctagtgatgcaggcctaggggagacccttgagcagagccagggtgcccacgtgctggccttggggcctctggaggcctctgctcgggcccggctggtgagagaggagctggccctgtacgggaagcggctggaggagtcaccatttaacaaccagatgcgactgctgctggtgaagcgggaatcaggccggccgctctacctgcgcttggtcaccgatcacctgaggctcttcacgctgtatgagcaggtgtctgagagactccggaccctgcctgccactgtccccctgctgctgcagcacatcctgagcacactggagaaggagcacgggcctgatgtccttccccaggccttgactgccctagaagtcacacggagtggtttgactgtggaccagctgcacggagtgctgagtgtgtggcggacactaccgaaggggactaagagctgggaagaagcagtggctgctggtaacagtggagacccctaccccatgggcccgtttgcctgcctcgtccagagtctgcgcagtttgctaggggagggccctctggagcgccctggtgcccggctgtgcctccctgatgggcccctgagaacagcagctaaacgttgctatgggaagaggccagggctagaggacacggcacacatcctcattgcagctcagctctggaagacatgtgacgctgatgcctcaggcaccttccgaagttgccctcctgaggctctgggagacctgccttaccacctgctccagagcgggaaccgtggacttctttcgaagttccttaccaacctccatgtggtggctgcacacttggaattgggtctggtctctcggctcttggaggcccatgccctctatgcttcttcagtccccaaagaggaacaaaagctccccgaggctgacgttgcagtgtttcgcaccttcctgaggcagcaggcttcaatcctcagccagtacccccggctcctgccccagcaggcagccaaccagcccctggactcacctctttgccaccaagcctcgctgctctcccggagatggcacctccaacacacactacgatggcttaataaaccccggaccatgaaaaatcagcaaagctccagcctgtctctggcagtttcctcatcccctactgctgtggccttctccaccaatgggcaaagagcagctgtgggcactgccaatgggacagtttacctgttggacctgagaacttggcaggaggagaagtctgtggtgagtggctgtgatggaatctctgcttgtttgttcctctccgatgatacactctttcttactgccttcgacgggctcctggagctctgggacctgcagcatggttgtcgggtgctgcagactaaggctcaccagtaccaaatcactggctgctgcctgagcccagactgccggctgctagccaccgtgtgcttgggaggatgcctaaagctgtgggacacagtccgtgggcagctggccttccagcacacctaccccaagtccctgaactgtgttgccttccacccagaggggcaggtaatagccacaggcagctgggctggcagcatcagcttcttccaggtggatgggctcaaagtcaccaaggacctgggggcacccggagcctctatccgtaccttggccttcaatgtgcctgggggggttgtggctgtgggccggctggacagtatggtggagctgtgggcctggcgagaaggggcacggctggctgccttccctgcccaccatggctttgttgctgctgcgcttttcctgcatgcgggttgccagttactgacggctggagaggatggcaaggttcaggtgtggtcagggtctctgggtcggccccgtgggcacctgggttccctttctctctctcctgccctctctgtggcactcagcccagatggtgatcgggtggctgttggatatcgagcggatggcattaggatctacaaaatctcttcaggttcccagggggctcagggtcaggcactggatgtggcagtgtccgccctggcctggctaagccccaaggtattggtgagtggtgcagaagatgggtccttgcagggctgggcactcaaggaatgctcccttcagtccctctggctcctgtccagattccagaagcctgtgctaggactggccacttcccaggagctcttggcttctgcctcagaggatttcacagtgcagctgtggccaaggcagctgctgacgcggccacacaaggcagaagactttccctgtggcactgagctgcggggacatgagggccctgtgagctgctgtagtttcagcactgatggaggcagcctggccaccgggggccgggatcggagtctcctctgctgggacgtgaggacacccaaaacccctgttttgatccactccttccctgcctgtcaccgtgactgggtcactggctgtgcctggaccaaagataacctactgatatcctgctccagtgatggctctgtggggctctgggacccagagtcaggacagcggcttggtcagttcctgggtcatcagagtgctgtgagcgctgtggcagctgtggaggagcacgtggtgtctgtgagccgggatgggaccttgaaagtgtgggaccatcaaggcgtggagctgaccagcatccctgctcactcaggacccattagccactgtgcagctgccatggagccccgtgcagctggacagcctgggtcagagcttctggtggtaaccgtcgggctagatggggccacacggttatggcatccactcttggtgtgccaaacccacaccctcctgggacacagcggcccagtccgtgctgctgctgtttcagaaacctcaggcctcatgctgaccgcctctgaggatggttctgtacggctctggcaggttcctaaggaagcagatgacacatgtataccaaggagttctgcagccgtcactgctgtggcttgggcaccagatggttccatggcagtatctggaaatcaagctggggaactaatcttgtggcaggaagctaaggctgtggccacagcacaggctccaggccacattggtgctctgatctggtcctcggcacacaccttttttgtcctcagtgctgatgagaaaatcagcgagtggcaagtgaaactgcggaagggttcggcacccggaaatttgagtcttcacctgaaccgaattctacaggaggacttaggggtgctgacaagtctggattgggctcctgatggtcactttctcatcttggccaaagcagatttgaagttactttgcatgaagccaggggatgctccatctgaaatctggagcagctatacagaaaatcctatgatattgtccacccacaaggagtatggcatatttgtcctgcagcccaaggatcctggagttctttctttcttgaggcaaaaggaatcaggagagtttgaagagaggctgaactttgatataaacttagagaatcctagtaggaccctaatatcgataactcaagccaaacctgaatctgagtcctcatttttgtgtgccagctctgatgggatcctatggaacctggccaaatgcagcccagaaggagaatggaccacaggtaacatgtggcagaaaaaagcaaacactccagaaacccaaactccagggacagacccatctacctgcagggaatctgatgccagcatggatagtgatgccagcatggatagtgagccaacaccacatctaaagacacggcagcgtagaaagattcactcgggctctgtcacagccctccatgtgctacctgagttgctggtgacagcttcgaaggacagagatgttaagctatgggagagacccagtatgcagctgctgggcctgttccgatgcgaagggtcagtgagctgcctggaaccttggctgggcgctaactccaccctgcagcttgccgtgggagacgtgcagggcaatgtgtactttctgaattgggaatgaagatgtgccactcgggaataatgataccccttgtgctagagat

SEQ ID NO: 190022 - DNA, 3314 bp, Homo sapiens
  Payload ID: 17524
  Gene Symbol: TELO2
  Gene Name: telomere maintenance 2
  Uniprot ID: Q9Y4R8
  ENST ID: ENST00000262319
  CDS Start-End: 280-2793
gatgcgccctcccgcctggcgtcctccgcagattcgcgctgagaggcccgcggagacccgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggtcgtcttcccgtgacgcccagatctgtcctgcaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcgggccccagcttccggctgatgaagatggcgcggctgctggccagattcctgcgcgagggccggctggcagtgctgatggaggcgcagtgtcggcagcagacgcagcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtggcctggattcctccgtgtccttcgtgtctcaggtccttgggaaagcctgtgtccacgggaggcagcaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggcctgaggtcctttcgagactgctggggaacctggtggtgaagaacaagaaggcccagtttgtgatgacccagaagcttctgttcttacagtcccggctcacgacgcccatgctgcagagcctgctgggccatctggccatggacagccagcggcgcccgctcctgctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatgaactgctggccagcatgatggcgggcgtgaagtgccgcctggacagtagcctgccccccgtgcgacgcctgggcatgatcgtggcagaggtcgttagtgcccggatccaccccgaggggcctcccctgaaattccagtacgaagaggatgaactgagcctcgagctgctggccttggcctccccccagcctgcgggtgacggcgcctcggaggcgggcacgtccctcgttccagccacggcagagccccctgcagagacccccgcagagatcgtggatggcggcgtcccccaagcacagctggcgggctctgactcggacctggacagcgatgatgagtttgtcccctacgacatgtcgggggacagagagctgaagagcagcaaggctcctgcctacgtccgggactgcgtggaagccctgaccacgtctgaggacatagagcgctgggaggcagccctgcgggcccttgagggcctggtctacaggagccccacagccactcgggaggtgagcgtggagctggccaaggtgcttctgcatctggaggagaagacctgtgtggtgggatttgcagggctgcgccagagagccctggtggccgtcacggtcacagacccggccccggtggccgactatctgacctcacagttctatgccctcaactacagcctccggcagcgcatggacatcctggatgtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaagggtggcccgaggcagggcccggcaggcagccccagcagattcaactccgtggccggccacttcttcttccccctccttcagcgctttgacaggcctctggtgaccttcgacctcttgggagaagaccagctggttctcggaaggctggcgcacaccttaggggccctgatgtgcctggctgttaacaccacggtggctgtggccatgggcaaggccctgctggaattcgtgtgggcccttcgcttccacatcgatgcctacgtgcgccaggggctgttgtcggccgtctcctccgtcctgctcagcctgcctgctgcgcgcctgctggaggacctgatggacgagctgctggaagcccggtcctggctggcggacgtggctgagaaagacccggacgaggactgcaggacgctggcactgagggccctgctgcttctgcagagactcaagaacaggctcctcccacccgcgtctccctagtccctggaggcctccccaggaccaccctcgccgacagcaaggcaggcggctgagcagcggcctggagcagcagagccaggctttgtagcgaggccaggtcttcggccgcatccggtacggagagtgcagatgcaggaaggcccggcctgccgctatttatagtgcagccagtccgctaaaaatacactgggcctgggcactgcccgccgggacatggcagcctggacgtggggctggggctgtgggcgctgctggcggggttgactcttccagtgagggcagaaccaggctggcaggaggggaggacggtgtacctgctgctcagagcccccaaggctctcctctgagagccaccaagcaggacagagcagctcttgtcccaggtccctcgggctgagcgccgtgtcaccaggagaatagtgctcacagcccaggcagggtgtgtggctcctggatgggctcgtggggcgggatgggacagggcacgggctctcagaaaataaactgctttattggaatta

SEQ ID NO: 190023 - DNA, 1667 bp, Homo sapiens
  Payload ID: 17524
  Gene Symbol: TELO2
  Gene Name: telomere maintenance 2
  ENST ID: ENST00000497339
  CDS Start-End: 264-1544
cccgcgcagcgcaggcgcagatgcgccctcccgcctggcgtcctccgcagattcgcgctgagaggcccgcggagacccgccccagaggctcaagaaaacccgcgggagcctcgcccggacccaggaactcgtgctcggggccaaccggctgggccgcgatcgcgtttcgtccggggccgcggcggccgtggggaatcggctgcagcgaatcggtggcgcgcggcgcctgagcgcgctgcagtcacccgggagccgggtccaggatggagccagcaccctcagaggttcgactcgccgtccgggaagccattcatgccctctcgtcttcggaggatggcggccacatcttctgcaccctggagtccctgaagcggtatctcggtgagatggagcctccagcgctcccgagggagaaggaggagtttgcctcggcccacttctcgcctgtcctcagatgtcttgccagcaggctgagcccagcctggctggagctgctgccccatggccgcctggaggagctgtgggccagcttcttcctggagggcccggcggaccaagccttcctggtgttgatggagaccatcgagggtgctgcgggccccagcttccggctgatgaagatggcgcggctgctggccagattcctgcgcgagggccggctggcagtgctgatggaggcgcagtgtcggcagcagacgcagcccggcttcatcctgctccgggagacgctgctgggcaaggtggtggccctgcccgatcacctgggcaaccgcctgcagcaggagaacttggccgagttcttcccccagaactacttccgcctgctcggcgaggaggtcgtccgggtgctgcaggcggttgtggactctctccaaggtggcctggattcctccgtgtccttcgtgtctcaggtccttgggaaagcctgtgtccacgggaggcagcaggagatcctgggcgtgctggtaccccggctggcagcgctcacccagggcagctacctgcaccagcgcgtctgctggcgcctggtggagcaagtgccggaccgggccatggaggctgtgctgaccgggctggtggaggccgcactggggcctgaggtcctttcgagactgctggggaacctggtggtgaagaacaagaaggcccagtttgtgatgacccagaagcttctgttcttacagtcccggctcacgacgcccatgctgcagagcctgctgggccatctggccatggacagccagcggcgcccgctcctgctgcaggtgctgaaggagctgttggagacgtggggcagcagcagtgccatccgccacactcccctgccgcagcagcgccacgtcagcaaggctgtcctcatctgcctggcgcaactcggggagccggaactgcgggacagccgggatgaactgctggccagcatgatggcgggcgtgaagtgccgcctggacagtagcctgccccccgtgcgacgcctgggcatgatcgtgcagattcaactccgtggccggccacttcttcttccccctccttcagcgctttgacaggcctctggtgaccttcgacctcttgggagaagaccagctggttctcggaaggctggcgcacaccttaggggccctgatgtgcctggctgttaacaccacggtggctgtggccatgggcaa

SEQ ID NO: 190024 - DNA, 479 bp, Homo sapiens
  Payload ID: 17524
  Gene Symbol: TELO2
  Gene Name: telomere maintenance 2
  ENST ID: ENST00000567423
  CDS Start-End: 1-479
cctggacagcgatgatgagtttgtcccctacgacatgtcgggggacagagagctgaagagcagcaaggctcctgcctacgtccgggactgcgtggaagccctgaccacgtctgaggacatagagcgctgggaggcagccctgcgggcccttgagggcctggtctacaggagccccacagccactcgggaggtggccgactatctgacctcacagttctatgccctcaactacagcctccggcagcgcatggacatcctggatgtgctgactctggctgcccaggagctgtctaggcctgggtgcctcgggaggactccccaacctggctccccaagtcccaacaccccgtgcctgccagaggcagccgtctctcagcctggcagtgccgtggcgtctgactggcgggtggtggtggaggagcggatcagaagcaagacccagcggctctccaagggtggcccgaggcagggcccggcag

SEQ ID NO: 190025 - DNA, 3268 bp, Homo sapiens
  Payload ID: 17525
  Gene Symbol: TERF1
  Gene Name: telomeric repeat binding factor (NIMA-interacting) 1
  Uniprot ID: P54274
  ENST ID: ENST00000276602
  CDS Start-End: 24-1283
agtacccaagcgagccatttaacatggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggccgaggccgaggccgtggctgccggctggatgctcgatttcctctgcctctctctttgccgagctttccgcgacggccgctccgaggacttccgcaggacccgcaacagcgcagaggctattattcatggactatccagtctaacagcttgccagttgagaacgatatacatatgtcagtttttgacaagaattgcagcaggaaaaacccttgatgcacagtttgaaaatgatgaacgaattacacccttggaatcagccctgatgatttggggttcaattgaaaaggaacatgacaaacttcatgaagaaatacagaatttaattaaaattcaggctatagctgtttgtatggaaaatggcaactttaaagaagcagaagaagtctttgaaagaatatttggtgatccaaattctcatatgcctttcaaaagcaaattgcttatgataatctctcagaaagatacatttcattccttttttcaacacttcagctacaaccacatgatggagaaaattaagagttatgtgaattatgtgctaagtgaaaaatcatcaacctttctaatgaaggcagcggcaaaagtagtagaaagcaaaaggacaagaacaataacttctcaagataaacctagtggtaatgatgttgaaatggaaactgaagctaatttggatacaagaaaaaggtctcacaagaatcttttcttatctaagttgcaacatggaacccagcaacaagaccttaataagaaagaaagaagagtaggaactcctcaaagtacaaaaaagaaaaaagaaagcagaagagccactgaaagcagaatacctgtttcaaagagtcagccggtaactcctgaaaaacatcgagctagaaaaagacaggcatggctttgggaagaagacaagaatttgagatctggcgtgaggaaatatggagagggaaactggtctaaaatactgttgcattataaattcaacaaccggacaagtgtcatgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaattaaaacctgatacgaaaaaaaaaaaattccagttaacctattttgtgtctgtaggctgacctcaaccctgtaacgtaacccattaaaatgaatttctttttttttaagacagagtttctctctgttgcccaggctggagtgcagtggcgcaatttcagctcactgcaacctctgcctcccaggttcaagtgattctcctgcctcagcctcctgagtagctgggattacaggcacacaccaccacgcccagctaatttttgtatttttagtagaggcggggtttcaccatgctggtcaggatgttctccaactcctgacttcatgatccacccacctcggcctcccaaagtgctgagattacagacgtgagccactgcgtcctgcctaaaatgaattttctagatgattgaataacagtagtcctttgatagaagataatgacttggtttatggccttaatatactacttaattacttaagatgtttattaatagaatgataaatgtacagagtaacctataagcatgacatacttttgctttcagtagtttcatgtaaagaaaaaaacttgaaaatagtaatacctgagtacccatgggaataatagacactggggaggtagggtggggagcgggagcaagagctgaaaaacttacctactggggactgtgctcactacctgggtgacaggatcatacgtaccccaaacctcaacatcacacagtatactcagctaacaaacctgcccatgtgtttcctgaatctaaaataaaaatcgaaataatttttttaaaaaagaaaaagacaatagtattacccatgggacaaaatttgtactattagcaagaatcattttgtgtctcatttagaaacaatttgacttttgttccagtgtttaaactttgacaaaaatggttttgaatagatctttataacctgatgccataaatacaagattctctgataccttcatttaatatatcaatattgggcctaaaacagtattctgtaaagcttaaattggtattaactatgatcatcttgatgtctatgatagataataaacaaggtcatacataccttactaaacaattttggtttttcaccaacattttattctttaaaagatttagactaacagaattatttagcatttcgagtcatgtgctttatttagcaagtgagtaaaaatattggaatattgaagtatttgcataaaaaatcaaatggtggtgttttgtaatctctattgtatttcctattaaggtttcatatattactttcccattgttcctgaatttgttatcctatatataaacagaaacatggatgagtaccatatacttcctgactcctttatcttgttacaccacaagatactgcactatttattggagatattttgatgattagtgccaaggctggcatcatgagccaaaatagacttgttaagtcaacctcattccaaacacctgctatagatcatcaaatctaagttgccattaattgtaagatgtcctgttatttcacacacacaactagaaaagaaaaatcggtatcaattatagtatggtgctttcttattttgaattttacttattagaagagctattttagatgtatttaaacataagatttttatcacataacttgtggatacaaaaaaagagaaattgtaagcaaaataagttgggtaatatattcctaaaacctc

SEQ ID NO: 190026 - DNA, 1677 bp, Homo sapiens
  Payload ID: 17525
  Gene Symbol: TERF1
  Gene Name: telomeric repeat binding factor (NIMA-interacting) 1
  Uniprot ID: P54274
  ENST ID: ENST00000276603
  CDS Start-End: 24-1343
agtacccaagcgagccatttaacatggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggccgaggccgaggccgtggctgccggctggatgctcgatttcctctgcctctctctttgccgagctttccgcgacggccgctccgaggacttccgcaggacccgcaacagcgcagaggctattattcatggactatccagtctaacagcttgccagttgagaacgatatacatatgtcagtttttgacaagaattgcagcaggaaaaacccttgatgcacagtttgaaaatgatgaacgaattacacccttggaatcagccctgatgatttggggttcaattgaaaaggaacatgacaaacttcatgaagaaatacagaatttaattaaaattcaggctatagctgtttgtatggaaaatggcaactttaaagaagcagaagaagtctttgaaagaatatttggtgatccaaattctcatatgcctttcaaaagcaaattgcttatgataatctctcagaaagatacatttcattccttttttcaacacttcagctacaaccacatgatggagaaaattaagagttatgtgaattatgtgctaagtgaaaaatcatcaacctttctaatgaaggcagcggcaaaagtagtagaaagcaaaaggacaagaacaataacttctcaagataaacctagtggtaatgatgttgaaatggaaactgaagctaatttggatacaagaaaaagtgttagtgacaaacagtctgcggtaactgaatcctcagagggtacagtatccttattgaggtctcacaagaatcttttcttatctaagttgcaacatggaacccagcaacaagaccttaataagaaagaaagaagagtaggaactcctcaaagtacaaaaaagaaaaaagaaagcagaagagccactgaaagcagaatacctgtttcaaagagtcagccggtaactcctgaaaaacatcgagctagaaaaagacaggcatggctttgggaagaagacaagaatttgagatctggcgtgaggaaatatggagagggaaactggtctaaaatactgttgcattataaattcaacaaccggacaagtgtcatgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaattaaaacctgatacgaaaaaaaaaaaattccagttaacctattttgtgtctgtaggctgacctc

SEQ ID NO: 190027 - DNA, 516 bp, Homo sapiens
  Payload ID: 17525
  Gene Symbol: TERF1
  Gene Name: telomeric repeat binding factor (NIMA-interacting) 1
  ENST ID: ENST00000518874
  CDS Start-End: 11-516
gccatttaacatggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggccgaggccgaggccgtggctgccggctggatgctcgatttcctctgcctctctctttgccgagctttccgcgacggccgctccgaggacttccgcaggacccgcaacagcgcagaggatgcacagtttgaaaatgatgaacgaattacacccttggaatcagccctgatgatttggggttcaattgaaaaggaacatgacaaacttcatgaagaaatacagaatttaattaaaattcaggctatagctgtttgtatggaaaatggcaactttaaagaagcagaagaagtctttgaaagaatatt

SEQ ID NO: 190028 - DNA, 627 bp, Homo sapiens
  Payload ID: 17525
  Gene Symbol: TERF1
  Gene Name: telomeric repeat binding factor (NIMA-interacting) 1
  ENST ID: ENST00000517390
  CDS Start-End: 69-627
ttaaaaccttcatgggggcagagactggctatctgaagtcatcacctcctaacacaggctggcagtagatgttcactattattcatggactatccagtctaacagcttgccagttgagaacgatatacatatgtcagtttttgacaagaattgcagcaggaaaaacccttgatgcacagtttgaaaatgatgaacgaattacacccttggaatcagccctgatgatttggggttcaattgaaaaggaacatgacaaacttcatgaagaaatacagaatttaattaaaattcaggctatagctgtttgtatggaaaatggcaactttaaagaagcagaagaagtctttgaaagaatatttggtgatccaaattctcatatgcctttcaaaagcaaattgcttatgataatctctcagaaagatacatttcattccttttttcaacacttcagctacaaccacatgatggagaaaattaagagttatgtgaattatgtgctaagtgaaaaatcatcaacctttctaatgaaggcagcggcaaaagtagtagaaagcaaaaggacaagaacaataacttctcaagataaacctagtggtaatgatgttgaaatggaaactgaagctaatt

SEQ ID NO: 190029 - DNA, 2983 bp, Homo sapiens
  Payload ID: 17526
  Gene Symbol: TERF2
  Gene Name: telomeric repeat binding factor 2
  Uniprot ID: Q15554
  ENST ID: ENST00000254942
  CDS Start-End: 18-1646
ggaacgctgtttctatcatggccgcgggagccgggacggcgggccccgcttccggcccgggcgtcgtgcgtgacccagcggcgtcacagccgaggaagcggcccggccgggagggcggggagggcgcgcggcgatcggacacgatggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcaggctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggaggccgcttcagcgccaccatccaagcccaccgttctcaaccaacccctccctggagagaagaatcccaaagtacccaaaggcaagtggaacagctctaatggggttgaagaaaaggagacttgggtggaagaggatgaactgtttcaagttcaggcagcaccagatgaagacagtacaaccaatataacaaaaaagcagaagtggactgtagaagaaagcgagtgggtcaaggctggagtgcagaaatatggggaaggaaactgggctgccatttctaaaaattacccatttgttaaccgaacagctgtgatgattaaggatcgctggcggaccatgaaaagacttggcatgaactgaaacaggctttcatttccacagaattcacaggagcatggttcctaataatagcccctgatagtctgctctttctttctttttcttttttttttttttttgagacagagtctcgctctgtcacccaggctggagtgcagtggcgtgatctcggctcactgcgacctccgtctcccgggctcacgccattctcctgcctcagcctcccgagtagctgggactacaggcgcccgccatcacgcccggctaatgttttgtatttttagtagagacggggtttcaccgtgttagccaggatggtctcgatctcctgacctcgtgatccacccaactcggcctcccaaagtgctgggattacaggcatgagccaccgcgcctggcatctgctgtttctttcagaagctgggctgggatgagaattttgggcaacctccttcgacgtgggggaggtcccatttccacttcatcactgttggagatcatggagctaagaagcagagccaagtccacccatgtccttggcagagatgacaggcacacagcttgtgcagtgccagaatatcattagcgtttcccttctttagtggtttgcttaaatttaaatccctggtaatctgtagaaccttctcctaggaaatggtgaagtctattaggagccacttgtgactccatgacctgttaaaaccagcaatgtgagtattatttggagtaaatttgttccacgtcaagttctggccttctgatgcaaatgcaaaggaacttagtctgttatgaacccaggttgatgacagaccagtccttgtggaataagattccctttaaaaactctttagccagtcgtgacatcaaccctagacctgtctgccttggcatttgctgtcaacatctgctgggctatgtaggcaggttaatcctccacttctcatgtggttgaaccagtgtgttttttggtaaaatggtgattgtagataagattagttccctgatcccctgccccctgtcccctgcctcttttcccaattcccttccttatgctggacttttaaagcttaaaaaaaatccgattgaatataaatgcctaatttcattctttgtgaaatggttgcttcctcctgattccctaattgtgctgtgttcgtgtcttgcactggaattcaacattcccttctccttttgtactgtgttgtgcttgctgtctctcccggacacccttaaagactgtctttttagcaaaaaatttcagtaaagtgttttctgtaatctttttttaaaaggtgagaactaattattgtccatacttgtagcattcttcattaaagtcttgcttctctcaactgtaa

SEQ ID NO: 190030 - DNA, 1129 bp, Homo sapiens
  Payload ID: 17526
  Gene Symbol: TERF2
  Gene Name: telomeric repeat binding factor 2
  Uniprot ID: Q15554
  ENST ID: ENST00000567296
  CDS Start-End: 18-899
ggaacgctgtttctatcatggccgcgggagccgggacggcgggccccgcttccggcccgggcgtcgtgcgtgacccagcggcgtcacagccgaggaagcggcccggccgggagggcggggagggcgcgcggcgatcggacacgatggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcaggctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacggtgcgccttggcccttctcccataaccatggtgtgcccttgaggatgtgcggggaatcagaatatctgaagtgaaaagagttgatgtgtgaaaaagacattgaattgtatgcactagctttcttaattaaatgccttaaaaatgcaaaagcaggccaggcgcaatggctcacgcctgtaatcccagcactttgggaggcccaggggggtggatcacctgaggtcaggagttcgagacctgcctgagcaacatggtgaaaccccatctctact

SEQ ID NO: 190031 - DNA, 917 bp, Homo sapiens
  Payload ID: 17526
  Gene Symbol: TERF2
  Gene Name: telomeric repeat binding factor 2
  ENST ID: ENST00000566750
  CDS Start-End: 69-917
ggggttggagcgccggggaagggggtccgggggaccgggagtcgggactgggggtcgcccagccaacgatgtcttctctcccagctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattg

SEQ ID NO: 190032 - DNA, 513 bp, Homo sapiens
  Payload ID: 17526
  Gene Symbol: TERF2
  Gene Name: telomeric repeat binding factor 2
  ENST ID: ENST00000569280
  CDS Start-End: 1-182
cggcggagcgcggcgcgggggaggcacggctggaagaggcagtcaatcgctgggtgctcaagttctacttccacgaggcgctgcgggcctttcggggtagccgctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatg

SEQ ID NO: 190033 - DNA, 669 bp, Homo sapiens
  Payload ID: 17526
  Gene Symbol: TERF2
  Gene Name: telomeric repeat binding factor 2
  ENST ID: ENST00000566257
  CDS Start-End: 52-669
aaaagagcttaaaaatgaaaactgtgctttgtcctagactgttcctttgatatggaggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgattggatttatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcacca

SEQ ID NO: 190034 - DNA, 573 bp, Homo sapiens
  Payload ID: 17526
  Gene Symbol: TERF2
  Gene Name: telomeric repeat binding factor 2
  ENST ID: ENST00000564982
  CDS Start-End: 1-300
gctgtcattatttgtatcaaaaacaaagaatttgaaaaggcttcaaaaattttgaaaaaacatatgtccaaggaccccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgattggatttgtaagtgaacttgtttgcatattgagtatattcttggtgaaagaagcagagaattaatgcaattctgtggcctcttcttcctgatgacatccttcctttcccagatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctgg

SEQ ID NO: 190035 - DNA, 431 bp, Homo sapiens
  Payload ID: 17526
  Gene Symbol: TERF2
  Gene Name: telomeric repeat binding factor 2
  ENST ID: ENST00000569542
  CDS Start-End: 1-431
agatgattaaaacggaatttacactgacagaagcagtggtcgaatccagtagaaaactggtcaaggaagctatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgaca

SEQ ID NO: 190036 - DNA, 791 bp, Homo sapiens
  Payload ID: 17526
  Gene Symbol: TERF2
  Gene Name: telomeric repeat binding factor 2
  ENST ID: ENST00000566051
  CDS Start-End: 1-148
gaacagctctaatggggttgaagaaaaggagacttgggtggaagaggatgaactgtttcaagttcaggaagtggactgtagaagaaagcgagtgggtcaaggctggagtgcagaaatatggggaaggaaactgggctgccatttctaaaaattacccatttgttaaccgaacagctgtgatgattaaggatcgctggcggaccatgaaaagacttggcatgaactgaaacaggctttcatttccacagaattcacaggagcatggttcctaataatagcccctgatagtctgctctttctttctttttcttttttttttttttttgagacagagtctcgctctgtcacccaggctggagtgcagtggcgtgatctcggctcactgcgacctccgtctcccgggctcacgccattctcctgcctcagcctcccgagtagctgggactacaggcgcccgccatcacgcccggctaatgttttgtatttttagtagagacggggtttcaccgtgttagccaggatggtctcgatctcctgacctcgtgatccacccaactcggcctcccaaagtgctgggattacaggcatgagccaccgcgcctggcatctgctgtttctttcagaagctgggctgggatgagaattttgggcaacctccttcgacgtgggggaggtcccatttccacttcatcactgttggagatcatggagctaagaagcagagccaagtccacccatgtccttggcagagatgacaggcacacagcttgtgcagtgccagaatatcatta

SEQ ID NO: 190037 - DNA, 2501 bp, Homo sapiens
  Payload ID: 17526
  Gene Symbol: TERF2
  Gene Name: telomeric repeat binding factor 2
  ENST ID: ENST00000569584
  CDS Start-End: 1-734
accccacaactcagaagctgagaaatgatctcctgaatattattcgagaaaagaacttggcccatcctgttatccagaacttttcatatgagaccttccagcagaagatgctgcgcttcctggagagccacctggatgacgccgagccctacctcctcacgatggccaaaaaggctttgaaatctgagtccgctgcctcaagtacagggaaggaagataaacagccagcaccagggcctgtggaaaagccacccagagaacccgcaaggcagctacggaatcctccaaccaccattggaatgatgactctgaaagcagctttcaagactctgtctggtgcacaggattctgaggcagcctttgcaaaactggaccagaaggatctggttcttcctactcaagctctcccagcatcaccagccctcaaaaacaagagacccagaaaagatgaaaacgaaagttcagccccggctgacggtgagggtggctcggaactgcagcccaagaacaagcgcatgacaataagcagattggtcttggaggaggacagccagagtactgagcccagcgcaggcctcaactcctcccaggaggccgcttcagcgccaccatccaagcccaccgttctcaaccaacccctccctggagagaagaatcccaagtatgaagaccttctttgtagaaattttggggctggttggtggtcctggttgggcctggtattacttccgtgaatgaagtaactttcagctaagttactcaccaccaaggcttgctcagactgctagaacttgacgcaggagtggccagtgacgacgtagccatccctgccggttctgaagccccgcatgtgggcttccaagccttgcactagggcatgagtgggaatggaaaggtttcagagcctcctactcatcgctgctttcatttttagcaaacatctgagtgtcttgacttctaaacattagtcttgtgtgttaaaagaaatttgtttgcattgggccacattatactttgacccttaaaaagagactgatgaatatgtataattttgcacccttctgagcatttgagacttggcaagttcagtgaatacttactaatctcccatgtcctgctaggtactgtggggcagtggctagaatactttaattttgctccccattgtgattctcatcctggctttgagttttgcttccctttgtgtcctgtggtggatcctccctccaggcagactggcctgcttgctctctggaacatgttgtttgtttctaccactgtacttttgcttcctctcattccccacagtggaccgtcatcccttcatcattgcttgtccaaatcccatttgtcctttaaagggaagaaaagccgttgttgatgaagtgctttctgggggcagagcactttcatgtatcatcttactgagtcactacaatcctcactctgtgaggtgatgatatattagccccattacacagaggagaagggctcagaaaagttcttagctcacctgaagtcacacagctaaaagtggcaaagatgggctttggatttttaatccaagtcagtcttgacagaaaagcccatggcctgtataccatatacaacaagttgcctctcttacaattctccttcctcaggctgggtgcgctggctcacacctgtaatcccagcactttgggaggctgaggcaggcagattacctgaggtcaggagtttgagagcagcctggccaacatggtgaaactccgtctctactaaaaatacaaaaattcgccaggcgtggtggtgggcgcctgtagtcccagctacttgggaagctgaggcaggagaattactggaacccgggaggcggaggctgcacagtgagccaagattgcaccactgcactccaggctgggcaacagagtgtgactccgtctcaaaaaaacaaaaacaaaaacaacttctccctcctccacagactcctccctggtcaccactagtgatccaccttatggatctcccaaggccacctctgcctctgctctgtgttgtattatttggggacctgtggtctggcatgcattgtacttggtgccccaaagggctgtggcatctgataagtgatttatcctcaggcacagatttgcactatgtcaccactacttgtatgtagaagtgagtcaccggctggcaaatgggcatagctgctgggcagtggatgcagctccatgcatgttattctcatttgatacaggatctcattggcttctcacagcaatcctgtgcactataggtattgctcccgggaacagatgaggaaacaggagagtgcgagattacagtaattttgtaaatgggaggatttgtgaaggtttcagacatacaccctctctcatatgtcaaggatatgaagtctaatgaatcccctaaagcagcaggggttggcaagctgtggccctggggccaaatcagcctactgcctgtttttgtaaataaagttttattggaacaca

SEQ ID NO: 190038 - DNA, 554 bp, Homo sapiens
  Payload ID: 17526
  Gene Symbol: TERF2
  Gene Name: telomeric repeat binding factor 2
  ENST ID: ENST00000567841
  CDS Start-End: 297-554
gtaagtaaatctaacttttctgcctttcttgtaatttccctccaaagctacttctatcactccactatctctatggattcccaaggagaacagcttcttctcctggggctgggaatacagcaaggaaggggacagattattatggtgtggccctgagactggggcttgtggaagaactgactgaagatgtttccttggccagggagagagagagagagctgtaaaacacccttgtgaaagctttgcttgtcaggcccttggggaaggagcacaccgtgtcccgattgctgcgggttatgcagtgtctgtcgcggattgaagaaggggaaaatttagactgttcctttgatatggaggctgagctcacaccactggaatcagctatcaatgtgctggagatgattaaaacggaatttacactgacagaagcagtggtcgaatccagtagaaaactggtcaaggaagctgctgtcattatttgtatcaaaaacaaagaatttgaaaaggcttcaaaaattttgaaaaaacatatgtccaaggaccccacaactcag

SEQ ID NO: 190039 - DNA, 2118 bp, Homo sapiens
  Payload ID: 17527
  Gene Symbol: TERF2IP
  Gene Name: telomeric repeat binding factor 2, interacting protein
  Uniprot ID: Q9NYB0
  ENST ID: ENST00000300086
  CDS Start-End: 98-1297
gcggcagaggcgtctgcggtgacagctcagtcagttgagctctgtgtgccaggcgctcgcgagggggtagctcttctagtagtgctcggcgtcagacatggcggaggcgatggatttgggcaaagaccccaacgggcccacccattcctcgactctgttcgtgagggacgacggcagctccatgtccttctacgtgcggcccagcccggccaagcgtcggctgtcgacgctcatcctgcacggcggcggcaccgtgtgccgagtgcaggagcccggggccgtgctgctggcccagcccggggaggcgctggccgaggcctcgggtgatttcatctccacgcagtacatcctggactgcgtggagcgcaacgagaggctggagctggaggcctatcggctgggccccgcctcggcggcggacaccggctcggaagcaaagcccggggccctggccgagggcgccgcggagccggagccgcagcggcacgccgggcggatcgccttcacggatgcggacgacgtagccatccttacctacgtgaaggaaaatgcccgctcgcccagctccgtcaccggtaacgccttgtggaaagcgatggagaagagctcgctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcggggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaatttggtgctcagaatgtagctcggaggattgaatttcgaaagaaataattggcaagataatgagaaaagaaaaaagtcatggtaggtgaggtggttaaaaaaaattgtgaccaatgaactttagagagttcttgcattggaactggcacttattttctgaccatcgctgctgttgctctgtgagtcctagatttttgtagccaagcagagttgtagagggggataaaaagaaaagaaattggatgtatttacagctgtccttgaacaagtatcaatgtgtttatgaaaggaagatctaaatcagacaggagttggtctacatagtagtaatccattgttggaatggaacccttgctatagtagtgacaaagtgaaaggaaatttaggaggcataggccatttcaggcagcataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgcacacaactctagagagtgttaagaataatgttacttggttaatgtgttatttattgagtattgtttgtgctaagcattgtgttagatttaaaaaattagtggattgactccactttgttgtgttgttttcattgttgaaaataaatataactttgtattcga

SEQ ID NO: 190040 - DNA, 639 bp, Homo sapiens
  Payload ID: 17527
  Gene Symbol: TERF2IP
  Gene Name: telomeric repeat binding factor 2, interacting protein
  ENST ID: ENST00000569234
  CDS Start-End: 1-300
ctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcgggggtgaggaggctgagcgcggggcctcgcggatatctgcgcgggtggggttgggatctttctcctggctgcctggcgtccatcttggcatcttcggtagcagcgcttggccccgccccctgttgacatccggaaccacagaataagagaactccagatttgcctgaagaagagtatgtgaaggaagaaatccaggagaatgaagaagcagtcaaaaagatgcttgtggaagccacccgggagtttgaggaggttgtggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtgg

SEQ ID NO: 190041 - DNA, 1266 bp, Homo sapiens
  Payload ID: 17527
  Gene Symbol: TERF2IP
  Gene Name: telomeric repeat binding factor 2, interacting protein
  ENST ID: ENST00000564671
  CDS Start-End: 1-369
gtggatgagagccctcctgattttgaaatacatataactatgtgtgatgatgatccacccacacctgaggaagactcagaaacacagcctgatgaggaggaagaagaagaagaagaaaaagtttctcaaccagaggtgtccatctcttcacagtcatggctgatcttgtcatccacttttgggagattctcctgtatctgggcagggtatgccttctctacatcaggatctcattcccatcacccagaatgcagtgctgtggcacgatcacagctctctgcagcctcaatttcccaggctcaagcaattctcccacctcagcctcccgagaagctggaactacaggaatgtgccaccgcatcgggctaatgttttgtatttttggtagagacagggtttagccatgttgcccaggctggtctcgaattcttgggctcaagcaatcctctcacctcagcctcctaaagtgcttggactagaggtgcaaatcaccatgcctgaccctttatctctacttttggccagaagcaatccagttaacactctatcatatattattcctcctactgttttctcctctctaaattcttcagctttggctgtttgcccattagtcactgcctgggagttttcaacttttaaaatttgtgacaacattgttaggtcattaagatgggtcctcatccgatgtaactggcgttcttacaagaagcagggaaatgacgtggcggagacacaggagggggaaataccgcgtgatgatggagttaaagacaggagttatgcagctgcaagccaagaacaccaagggctgctggtgacagcaagcgaggagggagcctggccctgctggcatcttgattcagacttccagcccctaccactctgagagaataaattcctgttgttttaagccacccagtttagggtgctttgttgcagccgccttaagaaaggaatacatcgtatcattcccagaaactgcttgagtcccagggtttgagactggaaagtgctgagcctccctcactaccagatgccaccttggcgagggtgagtaggtaggaaaggctgagcagtgaccccacattcatgtgctatggcacatttgagaacataccaaacaggaaatgaaactgatgtgaaacagaaatttccgtcataaaaacaatttgcatgaaacgttcactgtactaaaaaagtagatgatttaggacaattttaacttttaccctgaaaataaatgtttaaaccattcatgatgaa

SEQ ID NO: 190042 - DNA, 994 bp, Homo sapiens
  Payload ID: 17528
  Gene Symbol: TEN1
  Gene Name: TEN1 CST complex subunit
  Uniprot ID: Q86WV5
  ENST ID: ENST00000397640
  CDS Start-End: 299-670
gccccttctttctccgtggccctttggcgcgtgagtgacagcggcccagacagagggggcgatgtccgcgtcgtggctggggccggtcgcggggcagactaatcccctgctcctggccaggggaggctcccgagcggatcctcgggaaaggggctccgaaggtcaagaaactgccctgctgggcgtccggggagtgggaaaataaagcactttttgtatcccgcccctcccccgtcacgtgaccacgcgaggcggaaagaagaaatccgaggaccggcgacgcctagaacaggagcccatgatgctgcccaaacctgggacctattacctcccctgggaggttagtgcaggccaagttcctgatgggagcacgctgagaacatttggcaggttgtgcctctatgacatgattcagtccagagtaacactgatggctcagcacggatccgatcagcaccaggttcttgtctgtaccaagttggtggagcccttccacgcccaggtgggctccctgtacatcgtcctcggggagctccagcatcagcaggacagaggctccgtggtgaaggcgcgcgtgctgacctgtgtggaggggatgaacctgcccttgttggaacaagccatccgggagcagagactgtacaagcaggagcggggcggcagccagtaggaaacagcagcctagcaacaccctcacctgcttcagagcccgaaccctctggagctgcaggagcccgggagagcacagacgcctccccagcgacggccttgtctggagctcgaaagccgaggggcgggtgatgaatccagccccttcccctactttgggattggctcagcaatgagaacccagaaagcatgccataaatccgacagccccaccccaggagactgcaggtggccgagcttgggcgccggggccgtgcttggtgtggggccatggagggttccagaaggtcctggtgaataaaggcccagggggcgtgctcttgaa

SEQ ID NO: 190043 - DNA, 563 bp, Homo sapiens
  Payload ID: 17528
  Gene Symbol: TEN1
  Gene Name: TEN1 CST complex subunit
  ENST ID: ENST00000586891
  CDS Start-End: 261-563
agagggggcgatgtccgcgtcgtggctggggccggtcgcggggcagactaatcccctgctcctggccaggggaggctcccgagcggatcctcgggaaaggggctccgaaggtcaagaaactgccctgctgggcgtccggggagtgggaaaataaagcactttttgtatcccgcccctcccccgtcacgtgaccacgcgaggcggaaagaagaaatccgaggaccggcgacgcctagaacagaacagttcttcctggcactatgtgcctgagagggtgcaagaggaacgtgttgatgaagagagtcaaattgggcaaggcgcggtggctcatgcctgtaatcccagcactttgggaggccaaggagcccatgatgctgcccaaacctgggacctattacctcccctgggaggttagtgcaggccaagttcctgatgggagcacgctgagaacatttggcaggttgtgcctctatgacatgattcagtccagagtaacactgatggctcagcacggatccgatcagcaccaggttcttgtctgtaccaagttggtggagcccttc

SEQ ID NO: 190044 - DNA, 555 bp, Homo sapiens
  Payload ID: 17528
  Gene Symbol: TEN1
  Gene Name: TEN1 CST complex subunit
  ENST ID: ENST00000590676
  CDS Start-End: 389-555
gacagagggggcgatgtccgcgtcgtggctggggccggtcgcggggcagactaatcccctgctcctggccaggggaggctcccgagcggatcctcgggaaaggggctccgaaggtcaagaaactgccctgctgggcgtccggggagtgggaaaataaagcactttttgtatcccgcccctcccccgtcacgtgaccacgcgaggcggaaagaagaaatccgaggaccggcgacgcctagaacagtagagacgaggttgccctcaaactcctgagctcaagtgatctgcccgcctcagcctcctcaagtgctgggattataggcatgagccactgcacccaaccttgttctgattgttttgaagcatttgtagcttctagcaggagcccatgatgctgcccaaacctgggacctattacctcccctgggaggttagtgcaggccaagttcctgatgggagcacgctgagaacatttggcaggttgtgcctctatgacatgattcagtccagagtaacactgatggctcagcacggatccgatcagcaccaggttct

SEQ ID NO: 190045 - DNA, 862 bp, Homo sapiens
  Payload ID: 17528
  Gene Symbol: TEN1
  Gene Name: TEN1 CST complex subunit
  ENST ID: ENST00000588202
  CDS Start-End: 278-499
ctttggcgcgtgagtgacagcggcccagacagagggggcgatgtccgcgtcgtggctggggccggtcgcggggcagactaatcccctgctcctggccaggggaggctcccgagcggatcctcgggaaaggggctccgaaggtcaagaaactgccctgctgggcgtccggggagtgggaaaataaagcactttttgtatcccgcccctcccccgtcacgtgaccacgcgaggcggaaagaagaaatccgaggaccggcgacgcctagaacaggagcccatgatgctgcccaaacctgggacctattacctcccctgggaggttagtgcaggccaagttcctgatgggagcacgctgagaacatttggcaggttgtgcctctatgacatgattcagtccagagtaacactgatggctcagcacggatccgatcagcaccaggttcttgtctgtaccaagttggtggagcccttccacgcccagacagaggctccgtggtgaaggcgcgcgtgctgacctgtgtggaggggatgaacctgcccttgttggaacaagccatccgggagcagagactgtacaagcaggagcggggcggcagccagtaggaaacagcagcctagcaacaccctcacctgcttcagagcccgaaccctctggagctgcaggagcccgggagagcacagacgcctccccagcgacggccttgtctggagctcgaaagccgaggggcgggtgatgaatccagccccttcccctactttgggattggctcagcaatgagaacccagaaagcatgccataaatccgacagccccaccccaggagactgcaggtggccgagcttgggcgccggggccgtgcttg

SEQ ID NO: 190046 - DNA, 1570 bp, Homo sapiens
  Payload ID: 17529
  Gene Symbol: TEN1-CDK3
  Gene Name: TEN1-CDK3 readthrough (NMD candidate)
  ENST ID: ENST00000448471
  CDS Start-End: 77-994
gcccttcctggccgccatgtgtacccagagcctgggactggctgggctgggcagtgacccaggcagctctgtggccatggatatgttccagaaggtagagaagatcggagagggcacctatggggtggtgtacaaggccaagaacagggagacagggcagctggtggccctgaagaagatcagactggatttggagatggagggggtcccaagcactgccatcagggagatctcgctgctcaaggaactgaagcaccccaacatcgtccgactgctggacgtggtgcacaacgagaggaagctctatctggtgtttgagttcctcagccaggacctgaagaagtacatggactccaccccaggctcagagctccccctgcacctcatcaagagctacctcttccagctgctgcagggggtgagtttctgccactcacatcgggtcatccaccgagacctgaagccccagaacctgctcatcaatgagttgggtgccatcaagctggctgacttcggcctggctcgcgccttcggggtgcccctgcgcacctacacccatgaggtggtgacactgtggtatcgcgcccccgagattctcttgggcagcaagttctataccacagctgtggatatctggagcattggttgcatctttgcagagatggtgactcgaaaagccctgtttcctggtgactctgagattgaccagctctttcgtatctttcgtatgctggggacacccagcgaagacacatggcccggggtcacccagctgcctgactataagggcagcttccctaagtggaccaggaagggactggaagagattgtgcccaatctggagccagagggcagggacctgctcatgcaactcctgcagtatgaccccagccagcggatcacagccaagactgccctggcccacccgtacttctcatcccctgagccctccccagctgcccgccagtatgtgctgcagcgattccgccattgagaatgtcaaggccacactcagatcctttctcgagcagctgctgccccagctgcctcctacccattgccaagagaggatgcatctggggagagcaaagcactaaggaattcagcatcagcctgcagagggctgagtctgggttagtcctgcccgcaggttagcgagatcctgtgttgttttttgggttggacggtgccgtttcaaaatagaggcacagatgctccatgcacgaggggtccccgggcactggaacaagtgccaagttgaaggcagggggcctgccagagctgggtgtgggtattcaggccctcacctgccctgcctgcagggccagaccctgaggaaagggcgccccctgctggtctttttggatttaaaatgtttgggggaagagttgagttccagttcagtcccaagttaaacaggagggagtgagggagaggagagagggcgttccccggatcccaggagagctgggctatgactgcaataaggagttgttccttcacctgagatgtgcttcttttggttcatttctggcttgacaacaataaataaacgtggtatgttcctgag

SEQ ID NO: 190047 - DNA, 7641 bp, Homo sapiens
  Payload ID: 17530
  Gene Symbol: TNC
  Gene Name: tenascin C
  Uniprot ID: P24821
  ENST ID: ENST00000350763
  CDS Start-End: 413-7018
aattcgccaactgaaaaagtgggaaaggatgtctggaggcgaggcgtcccattacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 190048 - DNA, 6786 bp, Homo sapiens
  Payload ID: 17530
  Gene Symbol: TNC
  Gene Name: tenascin C
  ENST ID: ENST00000341037
  CDS Start-End: 130-6189
ttctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtatttttttt

SEQ ID NO: 190049 - DNA, 6281 bp, Homo sapiens
  Payload ID: 17530
  Gene Symbol: TNC
  Gene Name: tenascin C
  ENST ID: ENST00000423613
  CDS Start-End: 284-6070
gtctgctggagttcattttccccaaaaacggacccaccatgggcagacgcaccattagcacagtccccaaaggagatgcccaggactgtgggatggtcttgtgaaggtcgatgcacagatattgcagaggaatgctttaacttctagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaa

SEQ ID NO: 190050 - DNA, 7508 bp, Homo sapiens
  Payload ID: 17530
  Gene Symbol: TNC
  Gene Name: tenascin C
  ENST ID: ENST00000535648
  CDS Start-End: 413-5929
aattcgccaactgaaaaagtgggaaaggatgtctggaggcgaggcgtcccattacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaaccaaagccacagttgggcacgctaatctttagcaatattactccaaaaagcttcaacatgtcatggaccactcaagctgggctttttgcaaagattgttatcaatgtgagtgacgctcactcactgcatgagtcccagcaattcacagtctcaggagatgcaaagcaagctcacatcacaggcttggtggagaacactggctatgacgtcagtgtggcaggaaccaccttggctggggatcccaccagacccctcactgcctttgtcattacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggattt

SEQ ID NO: 190051 - DNA, 5517 bp, Homo sapiens
  Payload ID: 17530
  Gene Symbol: TNC
  Gene Name: tenascin C
  ENST ID: ENST00000542877
  CDS Start-End: 1-5517
atgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaaccaaagccacagttgggcacgctaatctttagcaatattactccaaaaagcttcaacatgtcatggaccactcaagctgggctttttgcaaagattgttatcaatgtgagtgacgctcactcactgcatgagtcccagcaattcacagtctcaggagatgcaaagcaagctcacatcacaggcttggtggagaacactggctatgacgtcagtgtggcaggaaccaccttggctggggatcccaccagacccctcactgcctttgtcattacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataa

SEQ ID NO: 190052 - DNA, 734 bp, Homo sapiens
  Payload ID: 17530
  Gene Symbol: TNC
  Gene Name: tenascin C
  ENST ID: ENST00000534839
  CDS Start-End: 459-734
ggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagatttctatagacacctagctgtgctttcttacaagaaaacatatccactggaccaaagcgcagcccccttcatgctgaagccacttcagtttgaaacgtaaaaaaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtg

SEQ ID NO: 190053 - DNA, 4946 bp, Homo sapiens
  Payload ID: 17530
  Gene Symbol: TNC
  Gene Name: tenascin C
  Uniprot ID: P24821
  ENST ID: ENST00000537320
  CDS Start-End: 124-4818
caagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgacca

SEQ ID NO: 190054 - DNA, 1844 bp, Homo sapiens
  Payload ID: 17530
  Gene Symbol: TNC
  Gene Name: tenascin C
  ENST ID: ENST00000544972
  CDS Start-End: 1-1844
ccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaag

SEQ ID NO: 190055 - DNA, 69 bp, Homo sapiens
  Payload ID: 17530
  Gene Symbol: TNC
  Gene Name: tenascin C
  ENST ID: ENST00000635336
  CDS Start-End: 1-69
gcctccacagaagccgaaccggaagttgacaaccttctggtttcagatgccaccccagacggtttccgt

SEQ ID NO: 190056 - DNA, 5008 bp, Homo sapiens
  Payload ID: 17531
  Gene Symbol: TNN
  Gene Name: tenascin N
  Uniprot ID: Q9UQP3
  ENST ID: ENST00000239462
  CDS Start-End: 114-4013
aagtaccaaggtctgcggcaggaggagaccggctcacaggagcagcagcattggaagaggcacccagcagcctcccaggcatcctggagggtctgctccctgtctttccaaggatgagtctccaggagatgttccgcttccctatggggctcctgcttggctctgtgctcctggtggcttcggccccagccactctggagcctcccggctgcagcaacaaggagcaacaggtcactgtcagccacacctacaagatcgatgtgcccaagtctgccttggttcaggttgacgctgaccctcagcccctcagtgacgatggggcttcgctcttggccctgggggaggccagggaggaacagaacatcatcttcaggcacaacatccgccttcagacgccacagaaggactgcgagttggcaggcagtgtccaggacctcctggcccgggtgaagaagctggaggaagagatggtggagatgaaggaacagtgtagtgcccagcgctgctgccagggagtcactgatctaagccgccactgcagcggccacgggaccttctccctggagacctgcagctgccactgcgaagagggcagggagggccccgcctgcgagcggctggcctgccccggggcgtgcagcggccacgggcgttgcgtggacgggcgctgcctgtgccatgagccctacgtgggtgccgactgcggctacccggcctgccctgagaactgcagcggacacggcgagtgcgtgcgcggcgtgtgccagtgccacgaagacttcatgtcggaggactgcagcgagaagcgctgtcccggcgactgcagcggccacggcttctgtgacacgggcgagtgctactgcgaggagggcttcacaggcctggactgtgcccaggtggtcaccccacagggcctgcagctgctcaagaacacggaggattctctgctggtgagctgggagccctccagccaggtggatcactacctcctcagctactaccccctggggaaggagctctctgggaagcagatccaagtgcccaaggagcagcacagctatgagattcttggtttgctgcctggaaccaagtacatagtcaccctgcgtaacgtcaagaatgaagtttctagcagcccacagcatctacttgccaccacagaccttgctgtgcttggcactgcctgggtgacagatgagactgagaactcccttgacgtggagtgggaaaacccctcaactgaggtggactactacaagctgcgatatggccccatgacaggacaggaggtagctgaggtcactgtgcccaagagcagtgaccccaagagccgatatgacatcactggtctgcacccggggactgagtataagatcacggtggtgcccatgagaggagagctggagggcaagccgatcctcctgaatggcaggacagaaattgacagtccaaccaatgttgtcactgatcgagtgactgaagacacagcaactgtctcctgggacccagtgcaggctgtcatagacaagtatgtagtgcgctacacttctgctgatggggacaccaaggaaatggcagtgcacaaggatgagagcagcactgtcctgacgggcctgaagccaggagaggcatacaaggtctacgtgtgggctgaaaggggcaaccaggggagcaagaaagctgacaccaatgccctcacagaaattgacagcccagcaaacctggtgactgaccgggtgactgagaataccgccaccatctcctgggacccggtacaggccaccattgacaagtacgtggtgcgctacacctctgctgacgaccaagagaccagagaggttctggtggggaaggagcagagcagcactgtcctgacaggcctgaggccaggtgtggagtacacagtgcatgtctgggcccagaagggggaccgagagagcaagaaggctgacaccaacgccccgacagatattgacagccccaaaaacctggtgactgaccgggtgacagagaatatggccacggtctcctgggacccggtgcaggccgccattgacaagtacgtggtgcgctacacctctgctggtggagagaccagggaggttccggtggggaaggagcagagcagcacagtcctgacaggcctgagaccgggtatggagtacatggtgcacgtgtgggcccagaagggggaccaggagagcaagaaggccgacaccaaggcccagacagacattgacagcccccaaaacctggtgaccgaccgggtgacagagaatatggccactgtctcctgggacccggtgcgggccaccattgacaggtatgtggtgcgctacacctctgccaaggacggagagaccagggaggttccggtggggaaggagcagagtagcactgtcctgacgggcctgaggccgggtgtggagtacacggtgcacgtgtgggcccagaagggggcccaggagagcaagaaggctgacaccaaggcccagacagacattgacagcccccaaaacctggtcactgactgggtgacagagaatacagccactgtctcctgggacccggtgcaggccaccattgacaggtatgtggtgcactacacgtctgccaacggagagaccagggaggttccagtggggaaggagcagagcagcactgtcctgacgggcctgaggccgggcatggagtacacggtgcacgtgtgggcccagaaggggaaccaggagagcaagaaggctgacaccaaggcccagacagaaattgacggccccaaaaacctagtgactgactgggtgacggagaatatggccactgtctcctgggacccggttcaggccaccattgacaagtacatggtgcgctacacctctgctgacggagagaccagggaggttccggtggggaaggagcacagcagcactgtcctgacgggcctgagaccaggcatggagtacatggtgcacgtgtgggcccagaagggggcccaggagagcaagaaggctgacaccaaggcccagacagaactcgaccctcccagaaaccttcgtccatctgctgtaacgcagtctggtggcatattgacctggacgcccccctctgctcagatccacggctacattctgacttaccagttcccagatggcacagttaaggagatgcagctgggacgggaagaccagaggtttgcgttgcaaggccttgagcaaggcgccacctaccctgtctcccttgttgcctttaagggtggtcgccggagcagaaatgtatccaccaccctctccacagttggtgcccgtttcccacacccttcggactgcagtcaggttcagcagaacagcaatgccgccagtggtctgtacaccatctacctgcatggcgatgccagccggcccctgcaggtgtactgtgacatggaaacggacggaggtggctggattgtcttccagaggcggaacactgggcagctggatttcttcaagcgatggaggagctatgtggaaggctttggggaccccatgaaggagttctggcttggacttgacaagctacacaacctcaccaccggcactccagcgcggtatgaggtgagagtggatttacagactgccaatgaatctgcctatgctatatatgatttcttccaagtggcctccagcaaggagcggtataagctgacagttgggaaatacagaggcacggcaggggatgctcttacttaccacaatggatggaagtttacaacttttgacagagacaatgatatcgcactcagcaactgtgccctgacacatcatggtggctggtggtataagaactgccacttggccaaccctaatggcagatatggggagaccaagcacagtgagggggtgaactgggagccttggaaaggacatgaattctccattccttacgtggagttgaaaatccgccctcatggctacagcagggagcctgtcctgggcagaaagaagcggacgctgagaggaaggctgcgaacgttctgatggcccgtgtgagcagtcctcgcaggagacaccaccagctgtggcagcttggggcggggtgggtagtggtcactgcggtctgggagtgctcagatagcccgcagaacaaatcatgtcaccaagcttcaagccatggaggttccttccctctcacctgcatttttgcccgtctttatgagggtcttgaaaatcaaaatagtagttgcacagtatgtgtaggaaagacagtactggaacggcaaggtttctcagcttatcttcagcaacatatatactggattagggcaagagaaggaatcacccagcacttcaccagttggaaatctctggaaatttacatctatgtatttaaagttctgctaatgcaaatcttttctctggaaagaagcacagaggaggagttctgatgacccaggggttagggctgagacaaccggacgtttgtcacctcctttcccattgggtttttaggaaaacagtgtgaacctcccccttttaatttctggtgttatgaggaagaataaaggggataaaaggggctaagatggactcatgtttagctaagttctgacttgtatccagcatgctggagaccaaagctgccgccttactgctatttttaagtgccctcttttcagtcatttgcataattgcgtccatagagctgcatatgttgtgaataaattctcactcatttcaactttgaataatttgactgtcttgataattggttcctcccaaagactcttctgcaactcccattcatgcccaccaggcctcagactccctcttttccccgccctgcactattggagccctgggttttgtgggagtgctcagcaccgtgagtcttactgtttgatcggacagttagcaagatcagatcctttttgcttattttctatcactttggagggttttctgtagcaaaatcagtgaccaatgaagtaacttaaattcctattgaagaaaaaaaataataaaccacttgattt

SEQ ID NO: 190057 - DNA, 4234 bp, Homo sapiens
  Payload ID: 17531
  Gene Symbol: TNN
  Gene Name: tenascin N
  ENST ID: ENST00000621086
  CDS Start-End: 1-3369
atgagtctccaggagatgttccgcttccctatggggctcctgcttggctctgtgctcctggtggcttcggccccagccactctggagcctcccggctgcagcaacaaggagcaacaggtcactgtcagccacacctacaagatcgatgtgcccaagtctgccttggttcaggttgacgctgaccctcagcccctcagtgacgatggggcttcgctcttggccctgggggaggccagggaggaacagaacatcatcttcaggcacaacatccgccttcagacgccacagaaggactgcgagttggcaggcagtgtccaggacctcctggcccgggtgaagaagctggaggaagagatggtggagatgaaggaacagtgtagtgcccagcgctgctgccagggagtcactgatctaagccgccactgcagcggccacgggaccttctccctggagacctgcagctgccactgcgaagagggcagggagggccccgcctgcgagcggctggcctgccccggggcgtgcagcggccacgggcgttgcgtggacgggcgctgcctgtgccatgagccctacgtgggtgccgactgcggctacccggcctgccctgagaactgcagcggacacggcgagtgcgtgcgcggcgtgtgccagtgccacgaagacttcatgtcggaggactgcagcgagaagcgctgtcccggcgactgcagcggccacggcttctgtgacacgggcgagtgctactgcgaggagggcttcacaggcctggactgtgcccaggtggtcaccccacagggcctgcagctgctcaagaacacggaggattctctgctggtgagctgggagccctccagccaggtggatcactacctcctcagctactaccccctggggaaggagctctctgggaagcagatccaagtgcccaaggagcagcacagctatgagattcttggtttgctgcctggaaccaagtacatagtcaccctgcgtaacgtcaagaatgaagtttctagcagcccacagcatctacttgccaccacagaccttgctgtgcttggcactgcctgggtgacagatgagactgagaactcccttgacgtggagtgggaaaacccctcaactgaggtggactactacaagctgcgatatggccccatgacaggacaggaggtagctgaggtcactgtgcccaagagcagtgaccccaagagccgatatgacatcactggtctgcacccggggactgagtataagatcacggtggtgcccatgagaggagagctggagggcaagccgatcctcctgaatggcaggacagaaattgacagtccaaccaatgttgtcactgatcgagtgactgaagacacagcaactgtctcctgggacccagtgcaggctgtcatagacaagtatgtagtgcgctacacttctgctgatggggacaccaaggaaatggcagtgcacaaggatgagagcagcactgtcctgacgggcctgaagccaggagaggcatacaaggtctacgtgtgggctgaaaggggcaaccaggggagcaagaaagctgacaccaatgccctcacagacattgacagcccccaaaacctggtgaccgaccgggtgacagagaatatggccactgtctcctgggacccggtgcgggccaccattgacaggtatgtggtgcgctacacctctgccaaggacggagagaccagggaggttccggtggggaaggagcagagtagcactgtcctgacgggcctgaggccgggtgtggagtacacggtgcacgtgtgggcccagaagggggcccaggagagcaagaaggctgacaccaaggcccagacagacattgacagcccccaaaacctggtcactgactgggtgacagagaatacagccactgtctcctgggacccggtgcaggccaccattgacaggtatgtggtgcactacacgtctgccaacggagagaccagggaggttccagtggggaaggagcagagcagcactgtcctgacgggcctgaggccgggcatggagtacacggtgcacgtgtgggcccagaaggggaaccaggagagcaagaaggctgacaccaaggcccagacagaaattgacggccccaaaaacctagtgactgactgggtgacggagaatatggccactgtctcctgggacccggttcaggccaccattgacaagtacatggtgcgctacacctctgctgacggagagaccagggaggttccggtggggaaggagcacagcagcactgtcctgacgggcctgagaccaggcatggagtacatggtgcacgtgtgggcccagaagggggcccaggagagcaagaaggctgacaccaaggcccagacagaactcgaccctcccagaaaccttcgtccatctgctgtaacgcagtctggtggcatattgacctggacgcccccctctgctcagatccacggctacattctgacttaccagttcccagatggcacagttaaggagatgcagctgggacgggaagaccagaggtttgcgttgcaaggccttgagcaaggcgccacctaccctgtctcccttgttgcctttaagggtggtcgccggagcagaaatgtatccaccaccctctccacagttggtgcccgtttcccacacccttcggactgcagtcaggttcagcagaacagcaatgccgccagtggtctgtacaccatctacctgcatggcgatgccagccggcccctgcaggtgtactgtgacatggaaacggacggaggtggctggattgtcttccagaggcggaacactgggcagctggatttcttcaagcgatggaggagctatgtggaaggctttggggaccccatgaaggagttctggcttggacttgacaagctacacaacctcaccaccggcactccagcgcggtatgaggtgagagtggatttacagactgccaatgaatctgcctatgctatatatgatttcttccaagtggcctccagcaaggagcggtataagctgacagttgggaaatacagaggcacggcaggggatgctcttacttaccacaatggatggaagtttacaacttttgacagagacaatgatatcgcactcagcaactgtgccctgacacatcatggtggctggtggtataagaactgccacttggccaaccctaatggcagatatggggagaccaagcacagtgagggggtgaactgggagccttggaaaggacatgaattctccattccttacgtggagttgaaaatccgccctcatggctacagcagggagcctgtcctgggcagaaagaagcggacgctgagaggaaggctgcgaacgttctgatggcccgtgtgagcagtcctcgcaggagacaccaccagctgtggcagcttggggcggggtgggtagtggtcactgcggtctgggagtgctcagatagcccgcagaacaaatcatgtcaccaagcttcaagccatggaggttccttccctctcacctgcatttttgcccgtctttatgagggtcttgaaaatcaaaatagtagttgcacagtatgtgtaggaaagacagtactggaacggcaaggtttctcagcttatcttcagcaacatatatactggattagggcaagagaaggaatcacccagcacttcaccagttggaaatctctggaaatttacatctatgtatttaaagttctgctaatgcaaatcttttctctggaaagaagcacagaggaggagttctgatgacccaggggttagggctgagacaaccggacgtttgtcacctcctttcccattgggtttttaggaaaacagtgtgaacctcccccttttaatttctggtgttatgaggaagaataaaggggataaaaggggctaagatggactcatgtttagctaagttctgacttgtatccagcatgctggagaccaaagctgccgccttactgctatttttaagtgccctcttttcagtcatttgcataattgcgtccatagagctgcatatgttgtgaataaattctcactcatttcaactttgaataatttgactgtcttgataattggttcctcccaaagactcttctgcaactcccattcatgcccaccaggcctcagactccctcttttccccgccctgcactattggagccctgggttttgtgggagtgctcagcaccgtgagtcttactgtttgatcg

SEQ ID NO: 190058 - DNA, 3719 bp, Homo sapiens
  Payload ID: 17531
  Gene Symbol: TNN
  Gene Name: tenascin N
  ENST ID: ENST00000622870
  CDS Start-End: 31-3399
ctggagggtctgctccctgtctttccaaggatgagtctccaggagatgttccgcttccctatggggctcctgcttggctctgtgctcctggtggcttcggccccagccactctggagcctcccggctgcagcaacaaggagcaacaggtcactgtcagccacacctacaagatcgatgtgcccaagtctgccttggttcaggttgacgctgaccctcagcccctcagtgacgatggggcttcgctcttggccctgggggaggccagggaggaacagaacatcatcttcaggcacaacatccgccttcagacgccacagaaggactgcgagttggcaggcagtgtccaggacctcctggcccgggtgaagaagctggaggaagagatggtggagatgaaggaacagtgtagtgcccagcgctgctgccagggagtcactgatctaagccgccactgcagcggccacgggaccttctccctggagacctgcagctgccactgcgaagagggcagggagggccccgcctgcgagcggctggcctgccccggggcgtgcagcggccacgggcgttgcgtggacgggcgctgcctgtgccatgagccctacgtgggtgccgactgcggctacccggcctgccctgagaactgcagcggacacggcgagtgcgtgcgcggcgtgtgccagtgccacgaagacttcatgtcggaggactgcagcgagaagcgctgtcccggcgactgcagcggccacggcttctgtgacacgggcgagtgctactgcgaggagggcttcacaggcctggactgtgcccaggtggtcaccccacagggcctgcagctgctcaagaacacggaggattctctgctggtgagctgggagccctccagccaggtggatcactacctcctcagctactaccccctggggaaggagctctctgggaagcagatccaagtgcccaaggagcagcacagctatgagattcttggtttgctgcctggaaccaagtacatagtcaccctgcgtaacgtcaagaatgaagtttctagcagcccacagcatctacttgccaccacagaccttgctgtgcttggcactgcctgggtgacagatgagactgagaactcccttgacgtggagtgggaaaacccctcaactgaggtggactactacaagctgcgatatggccccatgacaggacaggaggtagctgaggtcactgtgcccaagagcagtgaccccaagagccgatatgacatcactggtctgcacccggggactgagtataagatcacggtggtgcccatgagaggagagctggagggcaagccgatcctcctgaatggcaggacagaaattgacagtccaaccaatgttgtcactgatcgagtgactgaagacacagcaactgtctcctgggacccagtgcaggctgtcatagacaagtatgtagtgcgctacacttctgctgatggggacaccaaggaaatggcagtgcacaaggatgagagcagcactgtcctgacgggcctgaagccaggagaggcatacaaggtctacgtgtgggctgaaaggggcaaccaggggagcaagaaagctgacaccaatgccctcacagaaattgacagcccagcaaacctggtgactgaccgggtgactgagaataccgccaccatctcctgggacccggtacaggccaccattgacaggtatgtggtgcgctacacctctgccaaggacggagagaccagggaggttccggtggggaaggagcagagtagcactgtcctgacgggcctgaggccgggtgtggagtacacggtgcacgtgtgggcccagaagggggcccaggagagcaagaaggctgacaccaaggcccagacagacattgacagcccccaaaacctggtcactgactgggtgacagagaatacagccactgtctcctgggacccggtgcaggccaccattgacaggtatgtggtgcactacacgtctgccaacggagagaccagggaggttccagtggggaaggagcagagcagcactgtcctgacgggcctgaggccgggcatggagtacacggtgcacgtgtgggcccagaaggggaaccaggagagcaagaaggctgacaccaaggcccagacagaaattgacggccccaaaaacctagtgactgactgggtgacggagaatatggccactgtctcctgggacccggttcaggccaccattgacaagtacatggtgcgctacacctctgctgacggagagaccagggaggttccggtggggaaggagcacagcagcactgtcctgacgggcctgagaccaggcatggagtacatggtgcacgtgtgggcccagaagggggcccaggagagcaagaaggctgacaccaaggcccagacagaactcgaccctcccagaaaccttcgtccatctgctgtaacgcagtctggtggcatattgacctggacgcccccctctgctcagatccacggctacattctgacttaccagttcccagatggcacagttaaggagatgcagctgggacgggaagaccagaggtttgcgttgcaaggccttgagcaaggcgccacctaccctgtctcccttgttgcctttaagggtggtcgccggagcagaaatgtatccaccaccctctccacagttggtgcccgtttcccacacccttcggactgcagtcaggttcagcagaacagcaatgccgccagtggtctgtacaccatctacctgcatggcgatgccagccggcccctgcaggtgtactgtgacatggaaacggacggaggtggctggattgtcttccagaggcggaacactgggcagctggatttcttcaagcgatggaggagctatgtggaaggctttggggaccccatgaaggagttctggcttggacttgacaagctacacaacctcaccaccggcactccagcgcggtatgaggtgagagtggatttacagactgccaatgaatctgcctatgctatatatgatttcttccaagtggcctccagcaaggagcggtataagctgacagttgggaaatacagaggcacggcaggggatgctcttacttaccacaatggatggaagtttacaacttttgacagagacaatgatatcgcactcagcaactgtgccctgacacatcatggtggctggtggtataagaactgccacttggccaaccctaatggcagatatggggagaccaagcacagtgagggggtgaactgggagccttggaaaggacatgaattctccattccttacgtggagttgaaaatccgccctcatggctacagcagggagcctgtcctgggcagaaagaagcggacgctgagaggaaggctgcgaacgttctgatggcccgtgtgagcagtcctcgcaggagacaccaccagctgtggcagcttggggcggggtgggtagtggtcactgcggtctgggagtgctcagatagcccgcagaacaaatcatgtcaccaagcttcaagccatggaggttccttccctctcacctgcatttttgcccgtctttatgagggtcttgaaaatcaaaatagtagttgcacagtatgtgtaggaaagacagtactggaacggcaaggtttctcagcttatcttcagcaacatatatactggattagggcaagagaaggaatcacccagcacttcaccagttgg

SEQ ID NO: 190059 - DNA, 5190 bp, Homo sapiens
  Payload ID: 17532
  Gene Symbol: TNR
  Gene Name: tenascin R
  Uniprot ID: Q92752
  ENST ID: ENST00000263525
  CDS Start-End: 556-4632
ccaggcttcctcctctctttcacgtcagaggcaggaaccgactgtgctaaggctgttggctcaacacccagaggagacgggcagacccagggagagtgagagaagggggtcctctctgacccaaggaattaccactagtggagtgaagccacctgactttttgatcttattttggttgcctcctcattctccttccacccgtagccctgacagcttgggtttcatttctttcgtggagccttgtctcttcctcccagaataggaggaagggaagagaagggaaagaggagggctctctaggtgagcgcatcagctggctccagcctgagcaagcaagaattttcttcccaggaagctcctctcgctccccggccgcccacccccagcctgggtggctgtatcgttttaactgcatagagggcaggtctcttttggaattaggattaaagaaagtgcagtaaagagaaagcatcgaagacaccatcacaaaagattcccacaactccatgctgtgtgctgcaggctggtcctgaacccagatctctggctgagaggatgggggcagatggggaaacagtggttctgaagaacatgctcattggcatcaacctgatccttctgggctccatgatcaagccttcagagtgtcagctggaggtcaccacagaaagggtccagagacagtcagtggaggaggagggaggcattgccaactacaacacatccagcaaagagcagcctgtggtcttcaaccacgtgtacaacattaacgtgcccttggacaacctctgctcctcagggctagaggcctctgctgagcaggaggtgagtgcagaagacgagactctggcagagtacatgggccagacctcagaccacgagagccaggtcacctttacacacaggatcaacttccccaaaaaggcctgtccatgtgccagttcagcccaggtgctgcaggagctgctgagccggatcgagatgctggagagggaggtgtcggtgctgcgagaccagtgcaacgccaactgctgccaagaaagtgctgccacaggacaactggactatatccctcactgcagtggccacggcaactttagctttgagtcctgtggctgcatctgcaacgaaggctggtttggcaagaattgctcggagccctactgcccgctgggttgctccagccggggggtgtgtgtggatggccagtgcatctgtgacagcgagtacagcggggatgactgttccgaactccggtgcccaacagactgcagctcccgggggctctgcgtggacggggagtgtgtctgtgaagagccctacactggcgaggactgcagggaactgaggtgccctggggactgttcggggaaggggagatgtgccaacggtacctgtttatgcgaggagggctacgttggtgaggactgcggccagcggcagtgtctgaatgcctgcagtgggcgaggacaatgtgaggaggggctctgcgtctgtgaagagggctaccagggccctgactgctcagcagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaagaacaatgaagggggagtgattgctcaggtccccagcgatgttacgtcctttaaccagacaggactaaagcctggggaggaatacattgtcaatgtggtggctctgaaagaacaggcccgcagcccccctacctcggccagcgtctccacagtcattgacggccccacgcagatcctggttcgcgatgtctcggacactgtggcttttgtggagtggattccccctcgagccaaagtcgatttcattcttttgaaatatggcctggtgggcggggaaggtgggaggaccaccttccggctgcagcctcccctgagccaatactcagtgcaggccctgcggcctggctcccgatacgaggtgtcagtcagtgccgtccgagggaccaacgagagcgattctgccaccactcagttcacaacagagatcgatgcccccaagaacttgcgagttggttctcgcacagcaaccagccttgacctcgagtgggataacagtgaagccgaagttcaggagtacaaggttgtgtacagcaccctggcgggtgagcaatatcatgaggtactggtccccaggggcattggtccaaccaccagggccaccctgacagatctggtacctggcactgagtatggagttggaatatctgccgtcatgaactcacagcaaagcgtgccagccaccatgaatgccaggactgaacttgacagtccccgagacctcatggtgacagcctcctcggagacctccatctccctcatctggaccaaggccagtggccccattgaccactaccgaattacctttaccccatcctctgggattgcctcagaagtcaccgtacccaaggacaggacctcatacacactaacagatctagagcctggggcagagtacatcatttccgtcactgctgagaggggtcggcagcagagcttggagtccactgtggatgctttcacaggcttccgtcccatctctcatctgcacttttctcatgtgacctcctccagtgtgaacatcacttggagtgatccatctcccccagcagacagactcattcttaactacagccccagggatgaggaggaagagatgatggaggtctccctggatgccaccaagaggcatgctgtcctgatgggcctgcaaccagccacagagtatattgtgaaccttgtggctgtccatggcacagtgacctctgagcccattgtgggctccatcaccacaggaattgatcccccaaaagacatcacaattagcaatgtgaccaaggactcagtgatggtctcctggagccctcctgttgcatctttcgattactaccgagtatcatatcgacccacccaagtgggacgactagacagctcagtggtgcccaacactgtgacagaattcaccatcaccagactgaacccagctaccgaatacgaaatcagcctcaacagcgtgcggggcagggaggaaagcgagcgcatctgtactcttgtgcacacagccatggacaaccctgtggatctgattgctaccaatatcactccaacagaagccctgctgcagtggaaggcaccagtgggtgaggtggagaactacgtcattgttcttacacactttgcagtcgctggagagaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatctcctggcagcctcccagggcagagattgaaaattatgtcttgacctacaaatccaccgatggaagccgcaaggagctgattgtggatgcagaagacacctggattcgactggagggcctgttggagaacacagactacacggtgctcctgcaggcagcacaggacaccacgtggagcagcatcacctccaccgctttcaccacaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaagaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccc

SEQ ID NO: 190060 - DNA, 12949 bp, Homo sapiens
  Payload ID: 17532
  Gene Symbol: TNR
  Gene Name: tenascin R
  Uniprot ID: Q92752
  ENST ID: ENST00000367674
  CDS Start-End: 710-4786
cactagggggctgcttgtagggggatggaaaaaacggaggcttaaaaaaatcatgctgctgaaatttcagcaagaggggaaaagagagagcgcgtgagagagagagagagagagagagagagagagagagagagagagagacagcaaagcagtcccaggcttcctcctctctttcacgtcagaggcaggaaccgactgtgctaaggctgttggctcaacacccagaggagacgggcagacccagggagagtgagagaagggggtcctctctgacccaaggaattaccactagtggagtgaagccacctgactttttgatcttattttggttgcctcctcattctccttccacccgtagccctgacagcttgggtttcatttctttcgtggagccttgtctcttcctcccagaataggaggaagggaagagaagggaaagaggagggctctctaggtgagcgcatcagctggctccagcctgagcaagcaagaattttcttcccaggaagctcctctcgctccccggccgcccacccccagcctgggtggctgtatcgttttaactgcatagagggcaggtctcttttggaattaggattaaagaaagtgcagtaaagagaaagcatcgaagacaccatcacaaaagattcccacaactccatgctgtgtgctgcaggctggtcctgaacccagatctctggctgagaggatgggggcagatggggaaacagtggttctgaagaacatgctcattggcatcaacctgatccttctgggctccatgatcaagccttcagagtgtcagctggaggtcaccacagaaagggtccagagacagtcagtggaggaggagggaggcattgccaactacaacacatccagcaaagagcagcctgtggtcttcaaccacgtgtacaacattaacgtgcccttggacaacctctgctcctcagggctagaggcctctgctgagcaggaggtgagtgcagaagacgagactctggcagagtacatgggccagacctcagaccacgagagccaggtcacctttacacacaggatcaacttccccaaaaaggcctgtccatgtgccagttcagcccaggtgctgcaggagctgctgagccggatcgagatgctggagagggaggtgtcggtgctgcgagaccagtgcaacgccaactgctgccaagaaagtgctgccacaggacaactggactatatccctcactgcagtggccacggcaactttagctttgagtcctgtggctgcatctgcaacgaaggctggtttggcaagaattgctcggagccctactgcccgctgggttgctccagccggggggtgtgtgtggatggccagtgcatctgtgacagcgagtacagcggggatgactgttccgaactccggtgcccaacagactgcagctcccgggggctctgcgtggacggggagtgtgtctgtgaagagccctacactggcgaggactgcagggaactgaggtgccctggggactgttcggggaaggggagatgtgccaacggtacctgtttatgcgaggagggctacgttggtgaggactgcggccagcggcagtgtctgaatgcctgcagtgggcgaggacaatgtgaggaggggctctgcgtctgtgaagagggctaccagggccctgactgctcagcagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaagaacaatgaagggggagtgattgctcaggtccccagcgatgttacgtcctttaaccagacaggactaaagcctggggaggaatacattgtcaatgtggtggctctgaaagaacaggcccgcagcccccctacctcggccagcgtctccacagtcattgacggccccacgcagatcctggttcgcgatgtctcggacactgtggcttttgtggagtggattccccctcgagccaaagtcgatttcattcttttgaaatatggcctggtgggcggggaaggtgggaggaccaccttccggctgcagcctcccctgagccaatactcagtgcaggccctgcggcctggctcccgatacgaggtgtcagtcagtgccgtccgagggaccaacgagagcgattctgccaccactcagttcacaacagagatcgatgcccccaagaacttgcgagttggttctcgcacagcaaccagccttgacctcgagtgggataacagtgaagccgaagttcaggagtacaaggttgtgtacagcaccctggcgggtgagcaatatcatgaggtactggtccccaggggcattggtccaaccaccagggccaccctgacagatctggtacctggcactgagtatggagttggaatatctgccgtcatgaactcacagcaaagcgtgccagccaccatgaatgccaggactgaacttgacagtccccgagacctcatggtgacagcctcctcggagacctccatctccctcatctggaccaaggccagtggccccattgaccactaccgaattacctttaccccatcctctgggattgcctcagaagtcaccgtacccaaggacaggacctcatacacactaacagatctagagcctggggcagagtacatcatttccgtcactgctgagaggggtcggcagcagagcttggagtccactgtggatgctttcacaggcttccgtcccatctctcatctgcacttttctcatgtgacctcctccagtgtgaacatcacttggagtgatccatctcccccagcagacagactcattcttaactacagccccagggatgaggaggaagagatgatggaggtctccctggatgccaccaagaggcatgctgtcctgatgggcctgcaaccagccacagagtatattgtgaaccttgtggctgtccatggcacagtgacctctgagcccattgtgggctccatcaccacaggaattgatcccccaaaagacatcacaattagcaatgtgaccaaggactcagtgatggtctcctggagccctcctgttgcatctttcgattactaccgagtatcatatcgacccacccaagtgggacgactagacagctcagtggtgcccaacactgtgacagaattcaccatcaccagactgaacccagctaccgaatacgaaatcagcctcaacagcgtgcggggcagggaggaaagcgagcgcatctgtactcttgtgcacacagccatggacaaccctgtggatctgattgctaccaatatcactccaacagaagccctgctgcagtggaaggcaccagtgggtgaggtggagaactacgtcattgttcttacacactttgcagtcgctggagagaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatctcctggcagcctcccagggcagagattgaaaattatgtcttgacctacaaatccaccgatggaagccgcaaggagctgattgtggatgcagaagacacctggattcgactggagggcctgttggagaacacagactacacggtgctcctgcaggcagcacaggacaccacgtggagcagcatcacctccaccgctttcaccacaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaagaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccctccttccctcctttctttcttgacagtatctcactcttgctcagtctggagtgcagtggtgcaatctcagctcactacagcctcgacttcctgagcttaagtgatcctctcgtctcagcctcttgagtagctgggactacaggcatgagccaccatacctggctgatttttcttttattttttgtagagatgggggtctcactgtgttgtccaggctggtcacaaactcctggccttgaacaatcctcccacctcagcctcccaaaatgctgggattacaggctacagccactgcatccagccccaagtcctttataatgggccaaagattctcatcttctgacactcttattataccagccacatgtcctgttacctttcaagaacagtggctcttttctggccctgatggagtcttttgcctaatcccatcctgtcttagaccccagagcctcaaaagcccaaccagcattttggaatctagttcccaaggcattgcctgctcctggccctgggtggcacagtggctatgtgcctgtgagtcatcagccactgcccccaccctcaggtcagacagacagtcactttctgcaaaggtaggagggggagatggttgtagtttttagcacttttgggtcaagcattgaggaaaggactgaagaagtcaaaatcagggcactgccatagagattatagtttccatgggaaacacagatcttccctagccctgttttctccatttctggtcctatttgtcacagattctttttttctgaattgcaaaccgaaggcctcatatctatcttcacccaagccctccttagtgtaggtggcttaataagagtcaggagaagaaggtatatgcccagagagctatacccctgactgataatcctggaaagaggttgattttttttttcttttttggtcctatgggaaacaggaatgaccttcttaatgaggtgagatcatgagaagcctttccatcttcttttattattctgccttgcaaaggaaaaatgacaatagccaaaggaaattacatccagaaatccaaaggtgaataggtgataactgtgggcctacttcccattttatgagatgcactgtcttcactagcacaatttgatcttaagcccaagagagctagatgctctagaagccgtgacctttcaatttctcctccaaatccaatatcagcaaccatccccgcaacatctgcccagatccatgcccagttccctgagctgtcttctccctttcctctcccattcctcaaggcccagcaccattttctgtagtgcctatgtttgtctgaccagagcagtgtgtacctttgccaaccagttactggatgagccttagtgtcggcaattttctaatggaaatatcctcactcttaccaagctttgagaaccaagatgaaaagtcccttgggctgaccatcaggcctcggacctcatggggatgcagccagccaccattgaatggaggcgcttcccttgccgcaggcttctaggctttgttcactgcggcagtgtggatgtgacaggcataaccctgaaaaacctaggcaccacttgcatttctcagttaaccatgggcttcaacaaactgggaggaggaaaaaacagaaacagatcctttcaacaagcatgtaaattacagaagacttacctagagacggggcaacaatgaatagtaggaagcacattgcatgggaaacttgagggccgaggtacaggccaacagctgtcatcttagctacgacatgacatcggctgggttgtttcacctctctgggccagtttcttcatctgtcagatgagagattagactagaatgagttctaatttccctttcagttttgacggtcaatgatgctaatctgtgatctgaaaacctaagtagaaattggcatggtgggacagcacaattaggtaatgaaaattcactagactccctgtttaatgaggaaagaaggaaagaaggaaggaaggaaggaaggaaagaaggaaggggagggagggagggaaagaaaagagagagattgattcaggagtcataagtaaaacacacacacacacacacacacacacacgaaaatactgcagaaaagatcatgccgagtgagaggctgaactctttttgtccataaaaacagagaccaggtacctgggtggtgccagcacgcccacttcatcaaggaagttgaaatggaaaaagattatgtgttgtcaattcaggtgaaagtcaagaaacatcagtggaaacaaaaatcttccttttattgaaaccattctacactatggaacatttttataaatagtaccagcggcattgcatagctttattttgaagcaagaaagagacttcaaagatcagcttattcaaccctctataaaaggatttatagattccttttatttaatagggtgattttctcatgagttttcaccatgtttaaaagacactgtgccccactctcatcccaaggtctatggtcaacttgactcaatgctcataactttcctcgctgattcctgcttatcctgctcctccaagcacaactgcatttcccaaaggtagatccagtaagcaatactctcaaagcacccaccctatgcacaccagtttccctcaagggactcaaaaggaatcgaggtagacccttctcagaggctgtttaactacagacacatcaggatatgtactaatacccaaaaccaaaaccaccaccaatgactgcaatagattcactgtctagacccaaggtccaggcagtttcccttttttgcatttccccaacatataaagataatttccaacatatcagatgcacattcaccagggttatttctggaaggtgaaggggtcaggtgtagaagaggtggcaagaatgacaagtctgtggaaaactgttggccttgagaccacagtgaactggtggaaggggacttgctaagtgtggccacaaggtggcagtcacctcctgaaaccccgtgtgaaacgtcagcggggttgagaaaggccacgtctccaagtttccaggagagccaaaccaggactcaggaaaaccggccagctgatttgtatgggagattgatttgtaaaagaacaacaacaacatatggcagcaaggaaatgcaaagcaaacatctacaaatatttgaatccacctgtccctcacctaccaacttccccctctactactcataaagtggtaggactcctaatgccccgcttccttccacctgagaaccaaccagcaccctgatatttcaaagccagacctaaagaaccatggttgccaataacctcaatgccaaaccaaacaatcctaatcacatttttacttttcaaatccagtctcagagcagagctgtagattaagggacaaaaagtcattgtggaatcttttcaaatagctcttgtaaaagcatcagttgggaaagagtttatgagttcctctttgtcctctcctctggagaaaagacagaacatgcaagaacactagatacaccaagctatgggtgttgaaatagactagctggtgacctggatttgcaaataccctagggacatgaaaacattttttctttttctttttcttttttgtaacctccacccagaatttcaggaaaggtggggccacatgcccaggatatatggtattctactgcttgctttcttatcaccagaatactagtcaatctgatttcttagttccatgtcttttcttccaaggaggtagggcatggggttgggggacactttccgccttccttgcatctcactgtccactcttaaatttttattaagaaacctctgaaagattcaaaattcagttcagtttcaataatcccaaagaagttgggataatttgttttcacttgcttcaaacttgccacggctgcaggaggagtctcaggacctcagaggaatggggcagatgtgtgaagtctgggagtctgcctcccacccagatgccaggagctgcatactcagctctgcctcacttccctgatggtctgctttcatccaggttaccatgacagagagggtctatcctctaaagaaagctgagttacaggctggcccctggggttgttcctgtagcctctctttgaccacattcctgaagatgtttagctgaatgcctcctcaaacctttgcttcttccataacccaatcctacacatatgtgataaagctttcttcaacaatactgggtcatttggacactaccagtccagatgagaactcacagaccaaatgaaaactttcaaaagcaagcagggaaagtaactcctatatgctttaagatgatgtattggtgtagattcaggtccaatttgaaaaaatgtctctggttctttctaattgtatccactctggatttgtttatgccagttctacattcatcaagccttgagaaacaggtggaaagaagaaaaatataaaattaagaagaagctgatggatcattggagattcaaaacaagccttctaccggtggcaccacactgaaaggcagagacaaggcaggagcggccatgggagaggaagcagcattggcttctcacgttctggcctccagcctcccaccagagcttctgccattcacccacttaacttgaggagaaactaaggcaccaaggcctgtcactgcaccgaaaaccagaagcagaaggactttctttctttgctcaaccagttctgcctggatctgacttttgcgtcaccagtagtcacaagcctgatttgtcatctccagcattctgtttatttttttaaggtcaatctttgcctgaaacatgacttcattgcacctgcagcacttcattgtccaaatgtccttggcaaacctcacagtctttggacagtgttgcattttctccaaaggggaaatcctctctccttcctcaagcttaataaggctcttgcagtgcatccaaataacacagctcttgttcctcagacacactcagccccctctgataacttcataaaacagctccttattgtctgggccatgaagccaggctaatgctaaagttccagttcaaaaacatttaactctattatccttatgaggccagctctcctgggtactggcactcactcactggcaccatggattcaggtcaggtggtgcaaacatcttccctgagaagcaagccatacacccaacaggtctagaacacctaggtcacaagaaagggtttcagtccagatgcactgtcagtaagtgaacacaaggacaagaatgcatgaactgttattttcttcccatcactggtttagcagcccctagggagaccctgtgttgctctttaatattctgacatggagcactaatatgctcaacactgcctccaacaggcaaatgttggaaatacactttcagagctggatgggactcaagatcatctaatataatcctctcattttatttcctctcaaggaaaccaagggcaagaaagtttaggcaatttgctcacattcacacaggcaattagtaacagagctgagttcgggtctggtataggctttttaatttgattctccacaaatgaacactaagataaatagcatttattgcatacccactatttaccagatactgtgcaaagggctttacatatattactttactaaatcctcaccataaactttaagtcaggtttaaccattttatagaagagggaagggagggccaggaaggttaagtaacatgctcaaagtcacacagctactaaatagagccataatctgaacctttgtctaattttgaagcccttgatttttccacttcatgaggctgctctttatatttatttagctgagtgaccaccatcttggattttactaatattcttacaagggggctttgatgccacttcttctgacttttaagaaaaggaaattcttgcattatttttgccatgtactccaggggaccctcaatctcatcatcatggggaataagaaacattctgacatctctttccttttctttctttttaaatttggtagacgagggagagggtccccaacagaatgagagggggaagataagaaccagaacataaacccaataccccccaccccactcttttgggaacatcccaacattagaagagtgggatatccagtcatttttttcaagctggagcaggcagtgtagccaggattgaggaaggagaagccacagaataaacatggcacatgttctcagagcatcaattttactccagaatttgggaagaaaggattatattattagtgtattcaaaccagtatggatagcacaaatgcagatatcctataaattttgaggctaactccagcaggttgtagactgatttaggctacctccttccagactcccaggggtacaaacaccttcacagtcccctgcgggagtacatcagtggaaatatttggggaatgaggctagaaggcaggagatacattcagtttacttatccccctggtttcttttccccactccttacctgccccacatccctagtgggtgggaaggcatcagaagacagttggctacaatatcagctttctctgctactttggggaatttagaaggaaatcagtacttggcaacctggtatttttagctgccaggccaaaactccagacataaaccccttccctttaattgaatgatgtttatatataaaggaatagatctccccaagaaagaaccccagaacactggttccattccagtgtgggggctgcttgggcagcagtgacacctgtgcattagatgcaatagacacttcaattcctgcaaaaatgtcggccaactaagtgctcctttaccaactgcggaggcccagactcacaccatggtcccacagactcaaggtttagaatctatgtgagtctattttggttaacacacaggctcctccttccaatcattcacacacacacacacacacacacacacacacacatgcacacacacacatgcatgcacacatacacaggtgcacatgcacaaacacacacatctaatgattccaacctcgaatactccccaggcccatggggatgcccaagtaccctaagcaaatcactgtgacactgagggggtcattaactggggctccgagcagctgaaacccaccctggtggtctctagattgttgttctgagaaatcataaacaccaaatcctccaatccctttgaatttgagtttgtcattttaacctttaacagccttttcaggtaaaaataacaaagaccaatttattgactttgtagctacaatgagcttgaaaaagcgcttacttaaaagaaagactggaaggaagaaaaaaaaaagaaaatggagtacatactcctcagacgatgcacactttaattagctaaaataaaaataaaaatgtacagaggaagggagaggaaaaaccaacttctctgatcctttcatggcactgtagctcaaagactggaatctctgcttgttaaccattgttaactagtatttttagtcctggttgcttttagcctctgtatagttccttttttaaacacattttctatacgttaataaaagatcctgaaagaaa

SEQ ID NO: 190061 - DNA, 540 bp, Homo sapiens
  Payload ID: 17532
  Gene Symbol: TNR
  Gene Name: tenascin R
  ENST ID: ENST00000422274
  CDS Start-End: 1-540
gatcaacttccccaaaaaggcctgtccatgtgccagttcagcccaggtgctgcaggagctgctgagccggatcgagatgctggagagggaggtgtcggtgctgcgagaccagtgcaacgccaactgctgccaagaaagtgctgccacagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaagaacaatgaagg

SEQ ID NO: 190062 - DNA, 13132 bp, Homo sapiens
  Payload ID: 17533
  Gene Symbol: TNXB
  Gene Name: tenascin XB
  Uniprot ID: P22105
  ENST ID: ENST00000375244
  CDS Start-End: 203-12937
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtatggcctccacgaggggcggcgcgtgggcccggtgtccaccgtgggcgtgactgccccacaagaggatgtggacgagacccccagccctacagaaccaggcacagaggccccagggccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagctccagaggatgaagcagagaccacccaagcagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccggc

SEQ ID NO: 190063 - DNA, 13065 bp, Homo sapiens
  Payload ID: 17533
  Gene Symbol: TNXB
  Gene Name: tenascin XB
  ENST ID: ENST00000383159
  CDS Start-End: 203-12871
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacgctggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccactcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgtgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctaggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacaggagcaataaaggagaaactgaggtacccgg

SEQ ID NO: 190064 - DNA, 10084 bp, Homo sapiens
  Payload ID: 17533
  Gene Symbol: TNXB
  Gene Name: tenascin XB
  ENST ID: ENST00000424713
  CDS Start-End: 1-9890
ggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccaggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtatggcctccacgaggggcggcgcgtgggcccggtgtccaccgtgggcgtgactgccccacaagaggatgtggacgagacccccagccctacagaaccaggcacagaggccccagggccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcagggtcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacaggagcaataaaggagaaactgaggtacccgg

SEQ ID NO: 190065 - DNA, 13065 bp, Homo sapiens
  Payload ID: 17533
  Gene Symbol: TNXB
  Gene Name: tenascin XB
  ENST ID: ENST00000440248
  CDS Start-End: 203-12871
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccaccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggatgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctgacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgcgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggatgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccatcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtagacacctatgacatccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagacccaggagatcctgctcccaggagggatcacatctcaccagctccttggcctctttccctccacctcctacaatgcacggctccaggccacgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgg

SEQ ID NO: 190066 - DNA, 372 bp, Homo sapiens
  Payload ID: 17533
  Gene Symbol: TNXB
  Gene Name: tenascin XB
  ENST ID: ENST00000448391
  CDS Start-End: 350-372
agttcaggtttatgtgtgtgcatttcttttttattattattaaataaacaacttggagggagttgaaggaatggtggctgccttcctggctcgtgatggggagtttgggggaaagtggcttttccagagccagcatcaaagaatcaagcactgaagacatagctggctctgaggtggggtgggtgcgggatcacagaccgcatgtcatccccttgcccccacccctgcaactctggggtatatctgtgtctagcaacgatgtctcatggcgtgacagactagaggatacgcatccctggaatgtgagtcaacaggaaagatggggccccacgcccttcaggcctcctgaatgatgccagcccagtatgctct

SEQ ID NO: 190067 - DNA, 1902 bp, Homo sapiens
  Payload ID: 17533
  Gene Symbol: TNXB
  Gene Name: tenascin XB
  ENST ID: ENST00000433037
  CDS Start-End: 1-1902
ggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacgg

SEQ ID NO: 190068 - DNA, 372 bp, Homo sapiens; identical to SEQ ID NO: 190066
  Payload ID: 17533
  Gene Symbol: TNXB
  Gene Name: tenascin XB
  ENST ID: ENST00000442721
  CDS Start-End: 350-372

SEQ ID NO: 190069 - DNA, 6849 bp, Homo sapiens
  Payload ID: 17533
  Gene Symbol: TNXB
  Gene Name: tenascin XB
  ENST ID: ENST00000451159
  CDS Start-End: 9-6849
cctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactg

SEQ ID NO: 190070 - DNA, 13065 bp, Homo sapiens
  Payload ID: 17533
  Gene Symbol: TNXB
  Gene Name: tenascin XB
  ENST ID: ENST00000424718
  CDS Start-End: 203-12871
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggatgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctgacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgcgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcacactggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtagacacctatgacatccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagacccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgatcgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgg

SEQ ID NO: 190071 - DNA, 372 bp, Homo sapiens; identical to SEQ ID NO: 190066
  Payload ID: 17533
  Gene Symbol: TNXB
  Gene Name: tenascin XB
  ENST ID: ENST00000437547
  CDS Start-End: 350-372

SEQ ID NO: 190072 - DNA, 31 bp, Homo sapiens
  Payload ID: 17533
  Gene Symbol: TNXB
  Gene Name: tenascin XB
  ENST ID: ENST00000417283
  CDS Start-End: 9-31
cctcctgaatgatgccagcccagtatgctct

SEQ ID NO: 190073 - DNA, 6643 bp, Homo sapiens
  Payload ID: 17533
  Gene Symbol: TNXB
  Gene Name: tenascin XB
  ENST ID: ENST00000412618
  CDS Start-End: 1-6449
ctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggatgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctgacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgcgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcactggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcacactggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtagacacctatgacatccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagacccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgatcgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgg

SEQ ID NO: 190074 - DNA, 3125 bp, Homo sapiens
  Payload ID: 17533
  Gene Symbol: TNXB
  Gene Name: tenascin XB
  Uniprot ID: P22105
  ENST ID: ENST00000451343
  CDS Start-End: 910-2931
ccttgtgcatttgggctgaagacaaagatgactgcaggagtgggcaggccggagtggggcgccctggcctgtccccaggaaggaggaggagtctgcagccctgtgggcttcaacatccatcaaggagtccagagcaggagccaggccaggcgggagggaaaggccctgggaggggctctctaatctcccagccccgactctgccccgtcactgccactgctcctcattactcgctggggctgctgtcgcctccccgaagggtggccttgtccagatagcggcaaacctccctgccgtggatgagtcaggagcattttcttaagaggaacatcactggaaaacaaaatgagcggggacacagaaaccaacagcagtggctgcatttgtggtacaggctcctcttccagagctcgctgatgcccacctcagacaggcctgaccacggcacggctggtgggatttgccagtcacctcaaccagccagttccaccctcagcttctctcagaagggagcaccacactcctcaagctcagtgaatgtatcccggcatgggtggggccagagcctgtgatatctcgaggtgggctcggcaggacaccggggtgtggaagggggaagcgagcacctgactcagacagcgcgggagctcgcaggagtcacgaggccacagcgacttcattgtctgactgggcctggacctataaacttcccacctcagccttgggccaagcctggaagataaaaatggagcaccccatggcgcccctcactcagattctcccctgggcttctcccacgcagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgg

SEQ ID NO: 190075 - DNA, 320 bp, Homo sapiens
  Payload ID: 17533
  Gene Symbol: TNXB
  Gene Name: tenascin XB
  ENST ID: ENST00000424226
  CDS Start-End: 298-320
cttcaaccgcactgagtccctgaggcttgctgacgagttgagtggctgggtccagcgccaccagagaggccggaggaagatccctcagagggcccaggagagacagaagtctcagccacggaagaagtcacctccagttaaggcagtccccatccaaccccctggacccccagaaagggattctgtgggccagctgcaactatatcgccacccagaccgttcgcagccagcattcttggatgcaattgaccgacgggaagacacattttatgttgtctctttccgaaggcctcctgaatgatgccagcccagtatgctct

SEQ ID NO: 190076 - DNA, 372 bp, Homo sapiens; identical to SEQ ID NO: 190066
  Payload ID: 17533
  Gene Symbol: TNXB
  Gene Name: tenascin XB
  ENST ID: ENST00000427181
  CDS Start-End: 350-372

SEQ ID NO: 190077 - DNA, 2742 bp, Homo sapiens
  Payload ID: 17533
  Gene Symbol: TNXB
  Gene Name: tenascin XB
  ENST ID: ENST00000479795
  CDS Start-End: 142-2670
acagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacggccagccccctactatgttctgcctctcctcactctccagccaaagcagaagcagaaatctcaacttcgtggcgcaaccaagatagcttgaattttttcttctgtttaaacatctttttttgttgttgttataaaaatactttaatcacgagacaagaatttggcaactagagaaaagaaaaacaattcctggctgctcctcactaaaacaagcactgctaacattttaaagtgtttctccca

SEQ ID NO: 190078 - DNA, 2463 bp, Homo sapiens
  Payload ID: 17533
  Gene Symbol: TNXB
  Gene Name: tenascin XB
  Uniprot ID: P22105
  ENST ID: ENST00000546684
  CDS Start-End: 856-2463
ggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcacactggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtagacacctatgacatccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagacccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgatcgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctga

SEQ ID NO: 190079 - DNA, 13125 bp, Homo sapiens
  Payload ID: 17533
  Gene Symbol: TNXB
  Gene Name: tenascin XB
  ENST ID: ENST00000550212
  CDS Start-End: 203-12931
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccaccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggatgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctgacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgcgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggatgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagaggatgaagcagagaccacccaagcagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccatcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtagacacctatgacatccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagacccaggagatcctgctcccaggagggatcacatctcaccagctccttggcctctttccctccacctcctacaatgcacggctccaggccacgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgg

SEQ ID NO: 190080 - DNA, 13125 bp, Homo sapiens
  Payload ID: 17533
  Gene Symbol: TNXB
  Gene Name: tenascin XB
  ENST ID: ENST00000548649
  CDS Start-End: 203-12931
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccgcctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggatgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctgacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgcgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagaggatgaagcagagaccacccaagcagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcacactggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtagacacctatgacatccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagacccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgatcgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgg

SEQ ID NO: 190081 - DNA, 2852 bp, Homo sapiens
  Payload ID: 17533
  Gene Symbol: TNXB
  Gene Name: tenascin XB
  Uniprot ID: P22105
  ENST ID: ENST00000550539
  CDS Start-End: 1050-2657
agctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacaggagcaataaaggagaaactgaggtacccggc

SEQ ID NO: 190082 - DNA, 13125 bp, Homo sapiens
  Payload ID: 17533
  Gene Symbol: TNXB
  Gene Name: tenascin XB
  ENST ID: ENST00000549232
  CDS Start-End: 203-12931
tcctccccttctcctcccctgctcgctgcagactccctcctcactgtcgctgccgagatccacagtcggttgtggctcagcccctgttgcaggggacaagtgagggagacttccctgtcctgccctgagacgccgccctcccggggttggggacagagcaggtgcagaggcactgcagctgctcggttgcccagcctcctgaatgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacgctggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagaggtgccaaccattgagggcatgaggatgcatctcttggaggagacaacagttcggacagagtggaccccggctcctggccccgtggatgcctatgaaattcagttcatccccacgacagagggggcgagccccccattcacagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagggtcctcacccttgggcctcttggggactaccgatgagcctcctccctcaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccactcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaagctgcgcctagggcagatgacagtgagagacatcacctccgactccctcagcctctcctggacagtccccgagggccagtttgaccatttcttggtccagtttaagaatggggacgggcagcccaaggcggtgcgggtgccgggacacgaggatggggtcaccatctcgggcctggagccagaccacaagtacaagatgaacctgtacggcttccacggtggccagcgcgtgggccccgtgtctgctgttggtttaactgccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtacggcctccacgaggggcggcgtgtgggcccggtgtccaccgtgggcgtgactgccccacaagaggatgtggacgagacccccagccctacagaaccaggcacagaggccccagagccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctaggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagaggatgaagcagagaccacccaagcagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacaggagcaataaaggagaaactgaggtacccgg

SEQ ID NO: 190083 - DNA, 6842 bp, Homo sapiens
  Payload ID: 17533
  Gene Symbol: TNXB
  Gene Name: tenascin XB
  ENST ID: ENST00000613214
  CDS Start-End: 1-4635
atgatgccagcccagtatgctctaacctccagcctggttctcctggtgctgctgagcacagccagagcaggccccttctcttcacggtccaatgtgacactgccagccccccggccccctccccagccagggggccacacagtgggggctggagtgggaagcccctcttctcagctttacgagcacacagtggaaggaggggagaagcaggtggtattcacccaccgcattaacctgcccccttccactggctgtggctgtcccccaggcaccgagcccccagtccttgcttcagaggtacaggccctgagggtccgtctagagatcctggaggagttggtgaaggggctcaaggaacagtgcactgggggatgttgtcctgcctctgcccaagctggcacaggtcagacagatgtgcggaccctctgcagtctccatggtgtgtttgatctgagccgctgcacctgttcctgtgagccaggctggggtgggcccacctgctcagaccccacagatgctgagatccctccctcttccccaccctcagcctcggggtcctgcccagatgactgcaatgatcagggtcgctgtgtccgtggtcgttgcgtgtgctttcccggctacactggccccagctgtggctggccatcctgtcccggggactgccaaggccgtgggcgctgcgtgcagggcgtgtgtgtgtgccgggcaggcttctcaggccccgactgcagccagcgctcctgccctcgaggttgcagccagaggggacgctgtgagggtgggcgctgcgtgtgtgacccaggctacactggtgacgactgtggcatgaggagctgccctcgcggttgcagtcagagggggcgctgtgagaatgggcgctgcgtgtgtaaccccggctacactggcgaggactgtggggtgaggagctgccctcggggctgcagccagcggggacgctgcaaggacgggcgctgcgtgtgtgaccccggctacactggcgaggactgtggtacgcggagctgcccctgggactgtggcgagggcgggcgctgcgtggacggccgctgcgtgtgctggcccgggtacacaggcgaggactgcagcacgcggacatgtccgagggactgccggggccgcgggcgctgcgaggacggcgaatgcatttgcgacacgggctacagcggggacgactgcggcgtgcgcagctgccctggcgactgcaaccaaaggggccgctgcgaggacggccgctgcgtgtgctggccggggtacactggaaccgattgcggctcgcgcgcctgcccacgcgactgtagaggtcgcgggcgctgcgagaacggcgtgtgtgtttgcaatgcgggctacagcggcgaggactgcggtgtgcgcagctgtcctggggactgtcgtggccggggccgctgtgagagtggccgctgcatgtgttggccggggtacacaggccgggactgcggcacgcgcgcctgtcctggcgactgtcgcgggcgcgggcgctgcgtggatggccgctgcgtgtgcaacccgggcttcaccggtgaggactgtgggagccgtcgctgtcccggggactgccgtgggcacggcctttgcgaggatggcgtgtgcgtgtgtgacgcaggctactcaggggaagactgcagcacgcgcagctgccccgggggctgccgaggccgcggccagtgcctagatgggcggtgtgtgtgcgaggacggctactctggcgaggattgcggtgtgaggcagtgcccgaatgactgcagccagcacggcgtgtgccaggacggtgtgtgcatctgttgggaaggctacgtgagtgaggactgcagcatccgcacctgcccctccaactgccacgggaggggccgctgtgaggaagggcgctgcctgtgcgacccaggctacaccggccctacctgtgccacccgcatgtgcccggctgactgccggggacgtgggcggtgtgtgcaaggagtgtgcctgtgccacgtgggctatggcggtgaggactgcgggcaggaagagcctccagccagcgcctgccctggaggctgcgggccccgggaactgtgccgggcaggccagtgtgtgtgtgtagagggcttccgaggccctgactgtgccatccagacatgcccaggggactgccgtggccgaggagagtgtcacgatggcagctgtgtctgcaaagatgggtatgctggcgaagactgcggagaagcacgggttccaagctctgcctcagcctatgaccagagaggactggcccctggacaggagtaccaggtcactgtccgagcccttcgagggaccagctggggccttcctgcctccaagaccatcaccaccatgatcgatgggccccaggacctccgagtggtggctgtgacaccgacaacactggagcttggctggctgcgtccccaggctgaggtggaccgatttgtggtgtcctacgtcagtgccggcaaccagagggtgaggctggaagtgccccctgaagcagacgggacgctgctgactgacctgatgccaggcgtagaatatgtggtgactgtcacagcggagcggggccgggcagtcagctacccagcttctgtcagggccaacacagaggaaagggaggaggagtccccgcccaggccaagcctgtcccagcccccacggcggccttggggcaacctgacggccgagctgagccgtttccgcggcacggtgcaggacctggagcgccacctgcgggctcacggctacccactgcgggccaaccagacttacacgtcggtggcgcgccacatccatgaatacttgcagcggcaggtgctgggcagttccgccgatggcgcgcttctcgtgtctctcgacgggctccgcggccagttcgagcgcgtggtgctgcgctggcggcctcagccgcctgcagagggccccggcggtgagctgactgtgccgggcaccacgcgcaccgtcagcctgcccgacctcaggcccggcaccacctaccacgtggaggtccacggggtgcgggcggggcagacctccaagtcctacgccttcatcaccaccacaggcccctcgacgacgcaaggggcccaggctcctctcctgcagcagcgcccccaggagctgggagagttgagggtgctgggcagagatgagacagggcgcctccgtgtggtctggaccgcccagcctgacacctttgcctacttccaactgcgcatgcgggtgcccgaggggccgggggcacatgaggaagtgctgccaggggacgtccgccaggctctggtgcctccaccccctcctggaaccccgtatgagctgtcacttcatggggtccctcctgggggcaagccctctgaccccatcatctaccaaggcattatggacaaggatgaggagaagcctgggaagtcctcaggcccaccacgcctgggtgagctgacggtgacagacaggacctccgactccttgctcctgcgctggacggtccccgagggcgagtttgactccttcgtgatccagtacaaagacagggacgggcagccccaggtggtgcccgtggaaggaccccagcgctcggccgtcatcacctccctggatcctggccgcaagtacaaatttgtcctgtatgggtttgttggcaagaagaggcatggtccgctggtggctgaagccaagatcttgcctcagagtgacccaagtccagggactccaccccacctgggaaacctgtgggtgacagaccctaccccagattcactgcacctctcctggactgtccctgagggccagtttgacaccttcatggtccagtacagggacagggatggacggccccaggtggtacctgtggaagggcccgagcgttcatttgttgtctcctcactggaccctgaccacaagtacagattcactctgtttggaattgcgaacaagaagcggtatggccccctcacggccgatggcaccactgctccagagaggaaagaggagcccccccgccctgagttcctggagcagcccctcctgggggaactgacagtgaccggcgtgaccccagactccttgcgtctctcatggacagtggcccagggccccttcgactcattcatggtccagtacaaggatgcacaggggcagccccaggcagtgcctgttgcgggggatgagaatgaggttactgtccccggcctggatcccgaccggaagtataagatgaacctctacgggcttcgtggcaggcagcgtgtggggcccgagtctgtggtggccaagactgctcctcaggaggatgtggacgagacccccagccccacagaactgggcacggaggccccggagtcccccgaggagccgctcctgggggagctgacagtgacaggatcctcccctgattcgctgagcctcttctggaccgtcccccagggcagcttcgactctttcaccgtgcagtacaaggacagggatgggcggccccgggcggtgcgtgttgggggcaaggagagtgaggtcaccgtgggaggcctagagcccgggcacaagtacaagatgcacctgtacggcctccacgaggggcagcgcgtgggcccggtgtccgccgtgggcgtgacagccccacaacaagaagagacccctccagccactgagtccccgctggagccacgcctaggagagctgacagtgacagatgtgacccccaactctgtgggcctctcctggacagtccccgagggccagtttgactccttcatagtccagtacaaggacaaggacgggcagccccaggtggtgccggtggcggcagaccagcgagaggtcacagtctacaacctggagcctgagagaaaatataagatgaacatgtatggactacatgatgggcaacgcatgggccccctgtctgtggtcatcgtgacggctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattactgccggcagggaagaaacggaaactgagaccacggccccgacccctccagcgcctgagccccacctcggggagttgacagtggaggaggccacgtcacacaccctgcatctctcctggatggtgactgagggagaatttgactccttcgaaatccagtacacagatagagacgggcaactccaaatggtccgcataggaggtgaccggaatgacatcaccctctctggcctggaatccgaccacagatacctggtgaccctgtatggtttcagtgatgggaagcatgtaggtcctgtccatgtcgaggccctgacagtcccggaggaggagaagccttcagaacctcccaccgcaacccccgagccccccatcaagcctcgcctgggggagctgaccgtgacagatgccacccctgactccctcagcctgtcctggacagttcccgagggacagtttgaccacttcctggtccagtacaggaatggagatgggcagcccaaggcagtgagggtgccagggcacgaggaaggggtcaccatctcgggcctggagccagaccataaatacaagatgaacctgtacggcttccacggtggccagcgcatgggccctgtgtctgtcgtcggggtgacagctgcagaggaagagacccccagccccacagaacccagcatggaggccccggagcccgctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagtgaagtcaccgtggggggcctggagcctgggcgcaagtacaagatgcacctgtacggcctccacgaggggcggcgcgtgggcccagtgtctgctgtgggcgtcacggcccccgaagaggagtcccctgatgctcctcttgcaaa

SEQ ID NO: 190084 - DNA, 6083 bp, Homo sapiens
  Payload ID: 17533
  Gene Symbol: TNXB
  Gene Name: tenascin XB
  ENST ID: ENST00000611016
  CDS Start-End: 1-5889
gccccaggaaaggatgaagaaatggccccagcctcgacagaacctcccacccctgaaccccccatcaagcctcgcctggaggagctgaccgtgacagatgcgacccctgactccctcagcctgtcctggacggttcccgagggacagtttgaccacttcctggtccagtacaagaatggggatgggcagcccaaggcaacacgggtgccaggacatgaggacagggtcaccatctccggcctggagccagacaacaagtacaagatgaacctgtacggcttccacggtggccagcgtgtgggccccgtgtctgccatcggggtgacagctgcagaggaagagacccccagccccacagaacccagcatggaggccccggagccccctgaggagccgctcctgggggagctaacagtgacaggatcctcccctgactcgctgagcctctcctggaccgtcccccagggccgcttcgactccttcaccgtgcagtacaaggacagggacgggcggccccaggtggtgcgtgttgggggcgaggagagcgaggtcaccgtggggggcctggagcctgggcgcaaatacaagatgcacctgtatggcctccacgaggggcggcgcgtgggcccggtgtccaccgtgggcgtgactgccccacaagaggatgtggacgagacccccagccctacagaaccaggcacagaggccccagggccccccgaggagcctctcctgggggagctgacagtgacaggatcctcccctgactcgctgagcctttcctggaccgtcccccagggccgctttgactccttcaccgtgcagtacaaggacagggacgggcggccccaggcggtgcgtgttgggggccaggagagcaaggtcactgtgaggggcctggagcctgggcgcaagtacaagatgcacctgtacggcctccacgaggggcggcgcctgggcccggtgtctgccgtgggcgtcacagaggatgaagccgagaccacccaagcagtgcctaccatgacccctgagccccccatcaagcctcgcctgggggagctgaccatgacagatgccacccctgactccctcagcctgtcctggacggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtgggccccatctctgtcattggggtgacggctgcagaggaagagacccccagccccacggaactcagcactgaggccccggagccccctgaggagccgctcctgggggagctgacagtgacaggatcctcccctgactcgctgagcctctcctggaccatcccccagggccacttcgactccttcaccgtgcagtacaaggacagggacgggcggccccaggtgatgcgtgtcaggggcgaggagagcgaggtcaccgtggggggcctggagcccgggcgcaaatacaagatgcacctgtacggcctccacgaggggcggcgtgtgggcccggtgtccaccgtgggtgtgacagaggatgaagcagagaccacccaagcagtgcccaccacaacccctgagccccccaacaagcctcgcctcggggagctgaccgtgacagatgccacccctgactccctcagcctgtcctggatggtccccgagggccagtttgaccacttcctggtccagtacaggaatggggatgggcagcccaaggtggtgcgggtgccggggcacgaggacggggtcaccatctcaggcctggagccagaccacaagtacaagatgaacctgtacggcttccacggtggccagcgcgtgggccccatctctgtcattggggtgacagctgcagaggaagaaactcccgcccccacagaacccagcacggaggccccggagccccctgaggagccgctcctgggggagctgacagtgacaggatcctcccctgactcgctgagcctctcctggaccatcccccagggccgcttcgactccttcactgtgcagtacaaggacagggacgggcggccccaggtggtgcgtgtcaggggcgaggagagcgaggtcaccgtggggggcctggagcccgggtgcaaatacaagatgcacctgtacggcctccacgaggggcagcgcgtgggcccagtgtccgctgtgggtgtgacagctccaaaggatgaagccgagaccacccaagcagtgcctaccatgacccctgagccccccatcaagcctcgcctgggggagctgaccgtgacagatgccacccccgactccctcagcctgtcctggatggttcccgagggccagtttgaccacttcctggtccagtacaggaatggggatgggcagcccaaggcggtgcgggtgccggggcacgaggacggggtcaccatctcaggcctggagccagaccataaatacaagatgaacctgtacggcttccacggtggccagcgcgtaggccctgtgtctgccattggggtgacggaggaagagacccccagccccacagaacccagcactgaggccccggaggcccctgaggagccgctcctgggggagttgacagtgacaggatcctcccctgactcgctgagcctctcctggaccgtcccccagggccgcttcgactccttcaccgtgcagtacaaggacagggacgggcagccccaggtggtgcgtgtcaggggcgaggagagcgaggtcaccgtggggggcctggagcccgggcgcaaatacaagatgcatctgtacggcctccacgaggggcagcgcgtgggcccagtgtccaccgtgggcatcacggcgcccctgcccacaccactgccggtggagccccgcctgggggagctggcggtggcggccgtgacctcggactcagtgggcctctcatggacggtggcccagggcccctttgactccttcctggtacagtacagggacgcgcaggggcagccccaggcagtgcctgtgagcggagacctccgagcggtcgccgtctcggggctggacccggcccgcaagtacaagttcctgctctttggactccagaatgggaaacgccacggcccagtccctgtggaggccaggaccgccccagacaccaaaccgtctccccgcctgggggagctgactgtgacagatgcgacccctgactccgtgggcctctcgtggacggtccctgagggcgaattcgactccttcgtggtccagtacaaggataaggatggtcggctccaggtggtgccggtggcagccaaccagcgggaggtcacagtccagggcctggagcccagtaggaaatacaggttcctgctctatggtctgtcaggcaggaaacgactgggccccatctctgctgacagcaccacagctcccctggagaaggagctacctccccacctgggggaactgaccgtggctgaggagacctccagctctctgcgcctgtcctggacggtagcccagggcccctttgactccttcgtggtccagtacagggacacggacgggcagcccagggcagtgcctgtggccgcagaccagcgcacagtcaccgtagaggacctggagcctggcaagaaatacaagtttctgctctacgggctccttgggggaaagcgcctgggcccggtctctgccctgggaatgacagccccagaagaggacacaccagccccagagttagccccagaggcccctgagcctcctgaagagccccgcctaggagtgctgaccgtgaccgacacaaccccagactccatgcgcctctcgtggagcgtggcccagggcccctttgattccttcgtggtccagtatgaggacacgaacgggcagccccaggccttgctcgtggacggcgaccagagcaagatcctcatctcaggcctggagcccagcaccccctacaggttcctcctctatggcctccatgaagggaagcgcctggggcccctctcagctgagggcaccacagggctggctcctgctggtcagacctcagaggagtcaaggccccgcctgtcccagctgtctgtgactgacgtgaccaccagttcactgaggctcaactgggaggccccaccgggggccttcgactccttcctgctccgctttggggttccatcaccaagcactctggagccgcatccgcgtccactgctgcagcgcgagctgatggtgccggggacgcggcactcggccgtgctccgggacctgcgttccgggactctgtacagcctgacactgtatgggctgcgaggaccccacaaggccgacagcatccagggaaccgcccgcaccctcagcccagttctggagagcccccgtgacctccaattcagtgaaatcagggagacctcagccaaggtcaactggatgcccccaccatcccgggcggacagcttcaaagtctcctaccagctggcggacggaggggagcctcagagtgtgcaggtggatggccaggcccggacccagaaactccaggggctgatcccaggcgctcgctatgaggtgaccgtggtctcggtccgaggctttgaggagagtgagcctctcacaggcttcctcaccacggttcctgacggtcccacacagttgcgtgcactgaacttgaccgagggattcgccgtgctgcactggaagcccccccagaatcctgtggacacctatgacgtccaggtcacagcccctggggccccgcctctgcaggcggagaccccaggcagcgcggtggactaccccctgcatgaccttgtcctccacaccaactacaccgccacagtgcgtggcctgcggggccccaacctcacttccccagccagcatcaccttcaccacagggctagaggcccctcgggacttggaggccaaggaagtgaccccccgcaccgccctgctcacttggactgagcccccagtccggcccgcaggctacctgctcagcttccacacccctggtggacagaaccaggagatcctgctcccaggagggatcacatctcaccagctccttggcctctttccctccacctcctacaatgcacggctccaggccatgtggggccagagcctcctgccgcccgtgtccacctctttcaccacgggtgggctgcggatccccttccccagggactgcggggaggagatgcagaacggagccggtgcctccaggaccagcaccatcttcctcaacggcaaccgcgagcggcccctgaacgtgttttgcgacatggagactgatgggggcggctggctggtgttccagcgccgcatggatggacagacagacttctggagggactgggaggactatgcccatggttttgggaacatctctggagagttctggctgggcaatgaggccctgcacagcctgacacaggcaggtgactactccatgcgcgtggacctgcgggctggggacgaggctgtgttcgcccagtacgactccttccacgtagactcggctgcggagtactaccgcctccacttggagggctaccacggcaccgcaggggactccatgagctaccacagcggcagtgtcttctctgcccgtgatcgggaccccaacagcttgctcatctcctgcgctgtctcctaccgaggggcctggtggtacaggaactgccactacgccaacctcaacgggctctacgggagcacagtggaccatcagggagtgagctggtaccactggaagggcttcgagttctcggtgcccttcacggaaatgaagctgagaccaagaaactttcgctccccagcggggggaggctgagctgctgcccacctctctcgcaccccagtatgactgccgagcactgaggggtcgccccgagagaagagccagggtccttcaccacccagccgctggaggaagccttctctgccagcgatctcgcagcactgtgtttacaggggggaggggaggggttcgtacgggagcaataaaggagaaactgaggtacccgg

SEQ ID NO: 190085 - DNA, 12875 bp, Homo sapiens
  Payload ID: 17534
  Gene Symbol: TENM1
  Gene Name: teneurin transmembrane protein 1
  Uniprot ID: Q9UKZ4
  ENST ID: ENST00000371130
  CDS Start-End: 65-8242
gactgcttgcattaaaggacttcctcatcctttttttcatgaaactgagcttgcttaatcagagatggagcaaactgactgcaaaccctaccagcctctaccaaaagtcaagcatgaaatggatctagcttacaccagttcttctgatgagagtgaagatggaagaaaaccaagacagtcatacaactccagggagaccctgcacgagtataaccaggagctgaggatgaattacaatagccagagtagaaagaggaaagaagtagaaaaatctactcaagagatggaattctgtgaaacctctcacactctgtgctctggctaccaaacagacatgcacagcgtttctcggcatggctaccagctagagatgggatctgatgtggacacagagacagaaggtgctgcctcacctgaccatgcactaagaatgtggataaggggaatgaaatcagagcatagttcctgtttgtccagccgggccaactctgcattatccttgactgacactgaccatgaaaggaagtctgatggggaaaatggtttcaaattctctcctgtttgttgtgacatggaggctcaagctgggtctactcaagatgtgcagagcagcccacacaaccagttcaccttcagacccctcccaccgccacctccgcctcctcatgcctgcacctgtgccaggaagccaccccctgcagcggactctcttcagaggagatcaatgactacccgcagccagcccagcccagctgctccagctcccccaaccagcacgcaggattcagtccatctgcataacagctgggtcctgaacagcaacataccattggagaccaggcatttcctgttcaaacatggatctggttcctctgcgatcttcagtgcagccagtcagaactaccctctgacatccaataccgtgtactcgccccctcccaggcctcttcctcgaagcaccttttcccgacctgcctttacctttaacaaaccttacaggtgctgcaactggaagtgcacagcattgagcgccactgcaatcacagtgactttggccttgttactagcctatgtgattgcagtgcatttgttcggcctgacttggcagttgcaaccagttgaaggagagctgtatgcaaatggagttagcaaagggaacagggggaccgagtccatggacactacttactctccaattggaggaaaagtttctgataaatcagagaaaaaagtgtttcagaagggacgggcgatagacactggagaagttgacattggtgcacaggtcatgcagaccattccacctggtttattctggcgtttccagattactatccaccatccaatatatctgaagttcaatatttctttagccaaggactctctgctgggaatttatggcagaagaaacattccacctacacatactcagtttgattttgtaaaactaatggatggcaaacagctggtcaagcaggactccaagggctctgatgatacacagcactcccctcggaacctgatcttaacttcgcttcaggagacaggtttcatagagtatatggatcaaggaccttggtatctggcgttttacaatgatggaaaaaagatggagcaagtattcgtgttaactacagcaattgaaataatggatgactgttcaaccaattgcaatggaaatggagagtgtatctctggccattgtcattgtttcccaggattccttggacctgactgtgctagagattcctgccctgtgctgtgtggtgggaatggagaatacgagaaaggacactgtgtctgccggcatggctggaaggggccagagtgtgacgttccggaagaacaatgcattgatccaacatgctttggccacggcacctgcatcatgggagtctgcatctgtgtgccaggatacaaaggagaaatatgcgaggaagaggactgcctagacccaatgtgttccaaccatggcatctgtgtaaaaggagaatgtcactgttctactggctggggaggagttaactgtgaaacaccacttcctgtatgtcaagagcagtgctcaggacacggaacttttcttctggacgctggagtatgcagctgtgatcccaagtggacaggatctgactgctcaacagagctgtgtaccatggagtgtggtagccatggagtctgctcaagaggaatttgccagtgtgaagaaggctgggtaggaccaacatgtgaggaacgctcctgtcattctcattgtactgagcatggccaatgcaaagatggaaaatgtgagtgtagccctggatgggagggcgaccactgcacaattgctcactacttagatgctgtccgagatggctgcccagggctctgctttggaaatggacgatgtaccctggatcaaaatggttggcactgtgtgtgtcaggtgggttggagtgggacaggctgcaatgttgtcatggaaatgctttgtggagataacttggacaatgatggagatggtttaaccgactgtgtggatcctgactgttgtcaacaaagcaactgttatataagtcctctctgccagggctcaccagatcctcttgacctcattcagcaaagccaaactctcttctctcagcacacttcaagacttttttatgatcgaatcaaattcctcattggcaaggacagtactcatgtcattcctcctgaggtgtcatttgacagcaggcgtgcctgtgtgattcgaggccaagtggtggccatagatggaactcctctagtgggagtgaatgtcagtttcttgcaccacagtgattatgggtttaccatcagccggcaagatggaagctttgacctcgtggccatcggtggcatctctgtcatcttaatcttcgaccgatcccctttcctgcctgagaagagaacactctggttgccttggaatcagtttattgtggtagagaaagtcaccatgcagagagttgtatcagacccgccatcctgcgatatctccaactttatcagcccaaaccctattgtgcttccttcaccgctcacatcatttggagggtcctgtccagagaggggaactattgttcctgagctgcaggttgtacaggaggaaattcccattccctccagctttgtgaggctgagttacctgagcagccgcacccctgggtataaaaccctgctacggatccttctgacacattcaacgattcctgtaggcatgataaaagtacacctcacagtagctgtggaagggcgactcacacagaagtggtttcccgccgcaattaatcttgtctacacatttgcttggaacaagaccgacatctatggacagaaggtttggggcctggcagaggctttggtatctgtgggatatgaatatgaaacgtgccctgactttattctctgggagcaaaggacagtcgttttacaaggttttgagatggatgcttctaacctaggaggctggtctttgaataagcatcacattttgaatcctcaaagtggaatcatacataaagggaatggagaaaatatgttcatttcccagcagcccccagtcatatcaaccataatgggtaatggacaccaaaggagtgtagcctgcaccaactgcaatggcccagcccacaacaacaaactctttgctcctgtcgccttagcttctggccctgatggcagtgtgtatgttggcgacttcaattttgtaaggagaatatttccctcgggaaactccgttagtattttggaattaagcacaagtcctgctcacaaatactatctggctatggaccctgtgtctgaatcactctatctatcagacaccaatactcgcaaagtctacaagttgaaatctcttgtggagacgaaagatctgtccaagaattttgaagtggtggcaggaactggtgatcagtgccttccctttgaccagagtcattgtggagatggtgggagagcatcggaagcttcactgaatagccctcgaggcatcacagttgataggcatggatttatttactttgtggatgggactatgattcgcaaaattgatgagaatgctgtgatcacaactgtaatcggctcaaatggtctgacttccacacaaccactgagctgtgactcaggaatggacatcactcaggtgcgattagagtggccaacagaccttgcagtaaatcctatggacaattcattgtatgtcttggataacaacattgtgctgcaaatttctgagaacaggcgtgttcggatcatcgcaggacgccccattcactgccaggtgccaggcatcgatcatttcctggtcagcaaggtagcaattcactccactctagagtcagcgagggccatcagtgtctcccacagcgggctgctcttcatagctgaaacagacgagaggaaagtaaaccgcattcagcaagtaaccaccaatggggagatctacatcatcgctggtgcccccactgactgtgactgcaaaattgatccaaactgtgactgtttttcaggtgatggtggctatgccaaagatgcaaagatgaaagccccttcctccttagcagtgtcgcctgatggaaccctctatgtggcagacctcggaaatgttcgaattcgtaccatcagcaggaaccaagcccacctgaatgacatgaacatttatgagattgcttcacccgctgatcaggaactgtaccagttcactgtaaatggaacccacctacacaccctgaacttgataacaagggactatgtttataacttcacctacaattctgaaggtgacttgggcgcgattaccagcagcaatggcaattcagtgcacattcgccgtgatgcaggcggaatgccgctatggcttgtggtgcctggcggacaagtatactggctgactataagcagcaatggagtcctgaaaagagtgtcagcccaaggctataatctggccttaatgacctatccaggaaacacagggcttctggctaccaaaagtaacgaaaatggatggacaaccgtttatgagtatgaccccgagggacacctgaccaatgcaacgtttcccactggagaggtcagcagcttccacagtgacctggagaagctgacaaaagtggagctagatacttccaaccgtgaaaatgtcctcatgtcaaccaacttgacggcaactagtaccatatatattttaaaacaagaaaatactcaaagtacctatcgggtgaatccagatggttccctgcgtgtcacttttgccagcgggatggagatcggcctcagctcagagccccacatcctggcaggggcagtcaaccctaccctgggcaaatgcaacatctcattgcccggagagcacaatgcaaacctcatcgagtggcggcagaggaaggagcaaaacaaaggcaatgtttcggcttttgaaaggaggctgagggcccacaacagaaacctactctccatagattttgatcatataacccgcacaggaaagatctatgatgaccatcgaaaattcacccttcgaattctttatgaccagactgggcgacccattctgtggtctcctgtaagcagatataatgaagtgaacatcacatattcaccttcgggattggtgacgtttattcaaagaggaacgtggaatgaaaaaatggaatatgaccagagtgggaaaattatttcaagaacttgggctgatgggaaaatttggagctatacctacttagaaaaatctgtgatgcttctcctacacagccagcggcgttacatctttgagtatgaccaaccagattgtctgctctcagtcaccatgcctagcatggtgcgtcacagcttacaaaccatgctttcagtgggctactaccggaacatctacaccccaccggacagtagcacttcttttatccaagactatagtcgagatggccgattgctacagaccctgcatctggggacagggcgcagagtcttatacaagtacaccaagcaagcaaggctttctgaggttctctatgataccactcaggtcacattaacatatgaagagtcttctggagtgattaagacaatacacctgatgcatgacggattcatctgcacaatcagatacaggcaaacaggacctcttattggacgccagattttcagattcagtgaagaaggccttgtgaatgcacggttcgactacagctacaacaatttccgagtcacaagcatgcaagctgtaatcaatgaaacccctttgcctatagatctttaccgatatgttgatgtctctggcagaacagagcagtttggaaaattcagtgtaattaattacgatttaaatcaggtcataactactacagtgatgaaacacaccaaaatcttcagtgccaatggacaagtcattgaagtccaatatgaaatcctaaaggcaattgcctactggatgaccattcaatatgataatgtgggccgcatggtaatatgtgacataagggtaggagtagatgccaatataacaaggtacttctatgaatacgatgctgatgggcaacttcagactgtttctgtaaatgacaaaacccagtggcgttatagttacgatctgaatggaaacatcaacctcttaagccatgggaagagtgctcgtcttactcctctccgatatgacctccgagaccgcatcaccagattaggagaaattcagtataaaatggatgaagatggctttctgaggcagaggggaaatgatatttttgaatataattctaatggcctgctgcagaaagcctacaataaggcttctggctggactgtgcagtattactatgatgggcttgggcgacgtgtcgcgagtaagtccagcctagggcagcaccttcagttcttttatgcagaccttaccaaccccataagagttactcatttgtacaaccacacaagctcggagattacatctctgtattatgatctccaaggtcaccttattgccatggagttaagcagtggtgaagaatattatgtagcctgtgataatacaggtaccccactagctgtgttcagcagccgaggtcaggtcataaaggagatactatacacaccttatggcgatatctatcatgacacttaccctgactttcaggtcattattggttttcatggaggactctatgatttccttactaaattagtgcacctggggcaaagggattatgatgttgttgctggcagatggacaacgcctaatcatcacatatggaaacagttgaacctccttcctaaaccattcaacctctactcctttgaaaataactacccagttggcaaaattcaagatgttgcaaagtataccacagacatcagaagttggttggagctatttggtttccaattacacaatgtactacctggatttcccaaacctgaattagaaaatttagaattaacttacgagcttctacggcttcagacaaaaactcaagagtgggatcctggaaagactatcctgggcattcagtgtgaactccagaaacagctcaggaatttcatttccttggaccaactacctatgactccccgatacaatgatggacggtgccttgaaggagggaagcaaccaaggtttgctgctgtcccttctgtttttgggaaaggtataaaatttgccatcaaggatggcatagtaacagctgatattataggagtagccaatgaagatagcaggcggcttgctgccattctcaataatgcccattacctggaaaacctacattttaccatagaggggagggacactcactacttcattaagcttgggtctctggaggaagacctggtgctcatcggtaacactggggggaggcggattctggagaatggtgtcaatgtcactgtgtcccagatgacttctgtgttgaatgggaggactagacggtttgcagatattcagctccagcatggagccctgtgcttcaacatccggtatgggacaactgtcgaagaggaaaagaatcacgtgttggagattgccagacagcgcgcagtggcccaggcctggactaaggaacaaagaaggctgcaagagggggaagaggggattagggcatggacagaaggggaaaagcagcagcttttgagcactgggcgggtacaaggttacgatgggtattttgttttgtctgttgagcagtatttagaactttctgacagtgccaataatattcactttatgagacagagcgaaataggcaggaggtaacaaaaatatctctgcctttgcgtcaccaaagactgcctgtttttaaaacataaaatggtttattgtattggttttctagatcagaactctgtatatgtaaatatggaggaaaaacatatccaactgcctttcaatgtgacggaagatggtattttaatattgtttgtttaaactctttaagaaatgacagagatttttagttcttgtgtggcagtattcaaaataacacaagtagaactcaaacagctaaaaacagttttcagaaagcaccactttcaatttgccgagccatgcatatgttccaatatccagaaagaacccaaggttctctatctctattgtgagaagcagtttcatccttaactgttggcagaacttacgggctatttgaataggtggtgcaatagtatctgaaacttgcctttcgaaagactgccagccctttgacgttttccagatctgttataggaaacttaaaaacaggtgtaaaatgtcttcagccaccatctcctagagtgaggacccaattgcccttccttcttgattattcctccttgcttgttaaagtaaatgccatattgttgtgctgtgttttggcgtgtggtggctgggttctgtctaccatgcttccctgtgggtgtggtaaccagactgtatagccgctatttgctcgtgtgtacatgataccaaagcagctggccagcgtgacctctctcacacgacctgttttgactcaattttttactaaaagttgttcagctgtattggtatcatgtaaacatagcttttattaacctgggtaggaatttctcatttatatataggatgtgttttggtcatagtttcacattagtgattcagtatctatacactgacccaatggttttgtgcacatgaacggtaatttacttaaaagtatgattctggtacaaaaacaaacaaaggctttagcaggcatacgtgtctgggatgccgatacatacattaactactactgcagaaattcataagagccaaaaccttaaaaaaatagacctggtacttaagtgaaagtactaaagggaagaccagaccaaacatcacagcagttgctgccacattgtttcagcccacttagatttatctttcaaatgtacaattctgtattgaacatctcccagccatcttcaggaaatcgaatcaagtaaatcctttccaaccgaaaacatttcaactaactatagagaggcagactcatttttactaaaataatttatacagttagttattttcgttctccgtacttacccatttatctttatttaatcgtctctactgcctaggaaaataactattttccaggacgggttatttgttctgcgatcatttaaaatttggagaaaggtcaggattagtgttaatatcagctgcagtttctcaatctctaggaatcctgcagtaaaacaagccccttggtgagctggaagatttgtgcccagtgacaaagagatagtttgtaaaatgctgtgtaattgtaagttaccacaaatgaaaatacatgacagcacaatgtggcccgtagaaaattcccctgagccagcttctgcactttcatcaccgaatctgaacatttgctatgtctgaaggcaaatttatgatggaatgttagtttggattctttccagatgctacctaaatgcagtgtggggtcattgccttgctttgcgatgacagtttctttgaaaatatgcaaagtcataagctcatgttaaggtttttcaagagtctgcctcctactacacaaaggaaagcaagggaaaggaaatgaccctggcaaacagtagggaagggtgtattcaaacatttcattttcaaaaccttcgggttagaataccacttacacatgtattctgagagacagaattcatgaggaactcatctctctttataactggaaacacaccagcttgatatattgctaatccatactaaaatcatattattgggttttttctgaatcaggcctgtattaatggtacagtatttattcagaatggaattctaaaattactaacaaacttgttgaaaatttgaatacctccacaccaacctaaaaatggaccttaagttcctagaacctctgatgttcttttaaattaatggaaaaataatttgtgaactgtatatagagagtgcattcataaatgtgattatgtattttatcacaaatccaaaatgtcaatattagagtctattttgcttatattttaagcaattatacgtttttgcaattcattgatgatgtatcattttcaaactgctttaaatatccattagaaacaaatatttgaagcttttacttaatagtgattaccttgaactgtgcatttctagtttgtaatacgtatttggttggttcgtgcctttagtttgttaaagttacatttgtattatattcaggaaatgcactttttattacttacagctgtggttttaatactgccttgaactattattattctttttacaactcctaaagcttgagggaggaaagaaaaaaaaaacaaaactactaatcagtagtaaatcgaagagaaacattttggcatttcttaagaagaagatggagatattgagtatatcacttcctattcagctgaatagaaagaatgccttcattgacttgcagttctgcagtttaaattattgaaagaacaattcgtttgcatttcctgatgaaagtaaaagcatttttcagagaaacatatgaatttctcatacccagcagacagatggctgacactgcacagccacacaccattcgagtaagttaaagtgagagcatagtagttggactctcctatgaagaacattctgggctggaggcagggaatactccatggttgtttctttttcctacttaagcccattttgtttgtgcttttctgttttgttttgttttcactcttgcactacagtctagagatccaaatgaactgaaaagttcaaagtttaacacatttaaatatgtttacttttagttgtcattctaatcgttattgattagaagcatgactcctgaaggaaagggaaataaatctcaattcatactaacttgcaacaaaacacttttaccatataaataagtatatgatttatttttaacccaaaaaatgtataaaataagtgtgtcctttactgtcaatttatctagaagatctataatatatagactacatatatataatatatacaacatagccaaatgtatgaaaacttgacaatgtataatttggaattcacatgctacctatgtagacaggtatgaaattaagttataattttcatgagacattttcatcactgttgacacagtttcaagcattccatcatgttattttgactctttttcttttttttttctttaaaaatatatttttaactagaccaggccccactataatatcacttaagagagtcagggcaaagtttttgcatttatgaagatgtgttcatgtaagggtgattgtaatggagttcattggtaatagaagcaaaagtacagtaacgaagtattgaaaagaaaattttggagacattggagcatattatatatagcttgtggaaagacataaggctacagatggaatggaacattcctgttttcttgaagaaattcacatacacatagctgacctgactagtacttcagctcttccacagccttctataaaggttctttcttctgcaaagaaaacaaaacaaaacaaaacaaaacaaaaaaaacaaaaaaagcgcaaaaaacaaaaaaacaaaaaaaagcaaagtaaaatttaaaaatacagaaaacaaacaacaaaaaagaattcaaccataaatagtgactattattttcagtgtgtccttcatgtgaaagctattaaggaccaaatatactactgttcataagaagaaattactttctaaacagtaactgaaaatacttagagttaaacttgctgtggattttgtcttggcagttgtcatcttacattatttgtcaaaggaaatgtgtttggcagttaaaaatctttccttagatttagtggtggactttaacctcttaaataaatgttagtatatcagattgtgtccttgaaaaatattttacttgtatgaatcatgacaacgtctaaatctttactattcttctggcaaaagcatcagtaagaaagaaggcgaaaaagagaagtatagcctttatgtcagaaaaacattctttttagctgcttactttctcatgaaaagtaaagatgtttacagtgtatgccaagttttcagtttctgtataacaacaggtagaggttctaatcatattgaaaattgtgttataatggtctgagccatgttgctaggaaacaataggttccaattttgtattcctgctctcctgtgctgaaaagtgactggatactgtacaggttcatgttctctggctgcagttaaatggtcttttgcattttgctctggctttcaggccagaagcatgcatttttctacaagagcatcacaacaacatgctgtaaatatttaaagttaaacattatgtgttgatatttgaaagaaaagtactttgaatatttcatttttaaaaaataaaattgccaatgaaaaa

SEQ ID NO: 190086 - DNA, 12891 bp, Homo sapiens
  Payload ID: 17534
  Gene Symbol: TENM1
  Gene Name: teneurin transmembrane protein 1
  Uniprot ID: Q9UKZ4
  ENST ID: ENST00000422452
  CDS Start-End: 65-8263
gactgcttgcattaaaggacttcctcatcctttttttcatgaaactgagcttgcttaatcagagatggagcaaactgactgcaaaccctaccagcctctaccaaaagtcaagcatgaaatggatctagcttacaccagttcttctgatgagagtgaagatggaagaaaaccaagacagtcatacaactccagggagaccctgcacgagtataaccaggagctgaggatgaattacaatagccagagtagaaagaggaaagaagtagaaaaatctactcaagagatggaattctgtgaaacctctcacactctgtgctctggctaccaaacagacatgcacagcgtttctcggcatggctaccagctagagatgggatctgatgtggacacagagacagaaggtgctgcctcacctgaccatgcactaagaatgtggataaggggaatgaaatcagagcatagttcctgtttgtccagccgggccaactctgcattatccttgactgacactgaccatgaaaggaagtctgatggggaaaatggtttcaaattctctcctgtttgttgtgacatggaggctcaagctgggtctactcaagatgtgcagagcagcccacacaaccagttcaccttcagacccctcccaccgccacctccgcctcctcatgcctgcacctgtgccaggaagccaccccctgcagcggactctcttcagaggagatcaatgactacccgcagccagcccagcccagctgctccagctcccccaaccagcacgcaggattcagtccatctgcataacagctgggtcctgaacagcaacataccattggagaccaggcatttcctgttcaaacatggatctggttcctctgcgatcttcagtgcagccagtcagaactaccctctgacatccaataccgtgtactcgccccctcccaggcctcttcctcgaagcaccttttcccgacctgcctttacctttaacaaaccttacaggtgctgcaactggaagtgcacagcattgagcgccactgcaatcacagtgactttggccttgttactagcctatgtgattgcagtgcatttgttcggcctgacttggcagttgcaaccagttgaaggagagctgtatgcaaatggagttagcaaagggaacagggggaccgagtccatggacactacttactctccaattggaggaaaagtttctgataaatcagagaaaaaagtgtttcagaagggacgggcgatagacactggagaagttgacattggtgcacaggtcatgcagaccattccacctggtttattctggcgtttccagattactatccaccatccaatatatctgaagttcaatatttctttagccaaggactctctgctgggaatttatggcagaagaaacattccacctacacatactcagtttgattttgtaaaactaatggatggcaaacagctggtcaagcaggactccaagggctctgatgatacacagcactcccctcggaacctgatcttaacttcgcttcaggagacaggtttcatagagtatatggatcaaggaccttggtatctggcgttttacaatgatggaaaaaagatggagcaagtattcgtgttaactacagcaattgaaataatggatgactgttcaaccaattgcaatggaaatggagagtgtatctctggccattgtcattgtttcccaggattccttggacctgactgtgctagagattcctgccctgtgctgtgtggtgggaatggagaatacgagaaaggacactgtgtctgccggcatggctggaaggggccagagtgtgacgttccggaagaacaatgcattgatccaacatgctttggccacggcacctgcatcatgggagtctgcatctgtgtgccaggatacaaaggagaaatatgcgaggaagaggactgcctagacccaatgtgttccaaccatggcatctgtgtaaaaggagaatgtcactgttctactggctggggaggagttaactgtgaaacaccacttcctgtatgtcaagagcagtgctcaggacacggaacttttcttctggacgctggagtatgcagctgtgatcccaagtggacaggatctgactgctcaacagagctgtgtaccatggagtgtggtagccatggagtctgctcaagaggaatttgccagtgtgaagaaggctgggtaggaccaacatgtgaggaacgctcctgtcattctcattgtactgagcatggccaatgcaaagatggaaaatgtgagtgtagccctggatgggagggcgaccactgcacaattgctcactacttagatgctgtccgagatggctgcccagggctctgctttggaaatggacgatgtaccctggatcaaaatggttggcactgtgtgtgtcaggtgggttggagtgggacaggctgcaatgttgtcatggaaatgctttgtggagataacttggacaatgatggagatggtttaaccgactgtgtggatcctgactgttgtcaacaaagcaactgttatataagtcctctctgccagggctcaccagatcctcttgacctcattcagcaaagccaaactctcttctctcagcacacttcaagacttttttatgatcgaatcaaattcctcattggcaaggacagtactcatgtcattcctcctgaggtgtcatttgacagcaggcgtgcctgtgtgattcgaggccaagtggtggccatagatggaactcctctagtgggagtgaatgtcagtttcttgcaccacagtgattatgggtttaccatcagccggcaagatggaagctttgacctcgtggccatcggtggcatctctgtcatcttaatcttcgaccgatcccctttcctgcctgagaagagaacactctggttgccttggaatcagtttattgtggtagagaaagtcaccatgcagagagttgtatcagacccgccatcctgcgatatctccaactttatcagcccaaaccctattgtgcttccttcaccgctcacatcatttggagggtcctgtccagagaggggaactattgttcctgagctgcaggttgtacaggaggaaattcccattccctccagctttgtgaggctgagttacctgagcagccgcacccctgggtataaaaccctgctacggatccttctgacacattcaacgattcctgtaggcatgataaaagtacacctcacagtagctgtggaagggcgactcacacagaagtggtttcccgccgcaattaatcttgtctacacatttgcttggaacaagaccgacatctatggacagaaggtttggggcctggcagaggctttggtatctgtgggatatgaatatgaaacgtgccctgactttattctctgggagcaaaggacagtcgttttacaaggttttgagatggatgcttctaacctaggaggctggtctttgaataagcatcacattttgaatcctcaaagtggaatcatacataaagggaatggagaaaatatgttcatttcccagcagcccccagtcatatcaaccataatgggtaatggacaccaaaggagtgtagcctgcaccaactgcaatggcccagcccacaacaacaaactctttgctcctgtcgccttagcttctggccctgatggcagtgtgtatgttggcgacttcaattttgtaaggagaatatttccctcgggaaactccgttagtattttggaattaagaaacagagataccagacatagcacaagtcctgctcacaaatactatctggctatggaccctgtgtctgaatcactctatctatcagacaccaatactcgcaaagtctacaagttgaaatctcttgtggagacgaaagatctgtccaagaattttgaagtggtggcaggaactggtgatcagtgccttccctttgaccagagtcattgtggagatggtgggagagcatcggaagcttcactgaatagccctcgaggcatcacagttgataggcatggatttatttactttgtggatgggactatgattcgcaaaattgatgagaatgctgtgatcacaactgtaatcggctcaaatggtctgacttccacacaaccactgagctgtgactcaggaatggacatcactcaggtgcgattagagtggccaacagaccttgcagtaaatcctatggacaattcattgtatgtcttggataacaacattgtgctgcaaatttctgagaacaggcgtgttcggatcatcgcaggacgccccattcactgccaggtgccaggcatcgatcatttcctggtcagcaaggtagcaattcactccactctagagtcagcgagggccatcagtgtctcccacagcgggctgctcttcatagctgaaacagacgagaggaaagtaaaccgcattcagcaagtaaccaccaatggggagatctacatcatcgctggtgcccccactgactgtgactgcaaaattgatccaaactgtgactgtttttcaggtgatggtggctatgccaaagatgcaaagatgaaagccccttcctccttagcagtgtcgcctgatggaaccctctatgtggcagacctcggaaatgttcgaattcgtaccatcagcaggaaccaagcccacctgaatgacatgaacatttatgagattgcttcacccgctgatcaggaactgtaccagttcactgtaaatggaacccacctacacaccctgaacttgataacaagggactatgtttataacttcacctacaattctgaaggtgacttgggcgcgattaccagcagcaatggcaattcagtgcacattcgccgtgatgcaggcggaatgccgctatggcttgtggtgcctggcggacaagtatactggctgactataagcagcaatggagtcctgaaaagagtgtcagcccaaggctataatctggccttaatgacctatccaggaaacacagggcttctggctaccaaaagtaacgaaaatggatggacaaccgtttatgagtatgaccccgagggacacctgaccaatgcaacgtttcccactggagaggtcagcagcttccacagtgacctggagaagctgacaaaagtggagctagatacttccaaccgtgaaaatgtcctcatgtcaaccaacttgacggcaactagtaccatatatattttaaaacaagaaaatactcaaagtacctatcgggtgaatccagatggttccctgcgtgtcacttttgccagcgggatggagatcggcctcagctcagagccccacatcctggcaggggcagtcaaccctaccctgggcaaatgcaacatctcattgcccggagagcacaatgcaaacctcatcgagtggcggcagaggaaggagcaaaacaaaggcaatgtttcggcttttgaaaggaggctgagggcccacaacagaaacctactctccatagattttgatcatataacccgcacaggaaagatctatgatgaccatcgaaaattcacccttcgaattctttatgaccagactgggcgacccattctgtggtctcctgtaagcagatataatgaagtgaacatcacatattcaccttcgggattggtgacgtttattcaaagaggaacgtggaatgaaaaaatggaatatgaccagagtgggaaaattatttcaagaacttgggctgatgggaaaatttggagctatacctacttagaaaaatctgtgatgcttctcctacacagccagcggcgttacatctttgagtatgaccaaccagattgtctgctctcagtcaccatgcctagcatggtgcgtcacagcttacaaaccatgctttcagtgggctactaccggaacatctacaccccaccggacagtagcacttcttttatccaagactatagtcgagatggccgattgctacagaccctgcatctggggacagggcgcagagtcttatacaagtacaccaagcaagcaaggctttctgaggttctctatgataccactcaggtcacattaacatatgaagagtcttctggagtgattaagacaatacacctgatgcatgacggattcatctgcacaatcagatacaggcaaacaggacctcttattggacgccagattttcagattcagtgaagaaggccttgtgaatgcacggttcgactacagctacaacaatttccgagtcacaagcatgcaagctgtaatcaatgaaacccctttgcctatagatctttaccgatatgttgatgtctctggcagaacagagcagtttggaaaattcagtgtaattaattacgatttaaatcaggtcataactactacagtgatgaaacacaccaaaatcttcagtgccaatggacaagtcattgaagtccaatatgaaatcctaaaggcaattgcctactggatgaccattcaatatgataatgtgggccgcatggtaatatgtgacataagggtaggagtagatgccaatataacaaggtacttctatgaatacgatgctgatgggcaacttcagactgtttctgtaaatgacaaaacccagtggcgttatagttacgatctgaatggaaacatcaacctcttaagccatgggaagagtgctcgtcttactcctctccgatatgacctccgagaccgcatcaccagattaggagaaattcagtataaaatggatgaagatggctttctgaggcagaggggaaatgatatttttgaatataattctaatggcctgctgcagaaagcctacaataaggcttctggctggactgtgcagtattactatgatgggcttgggcgacgtgtcgcgagtaagtccagcctagggcagcaccttcagttcttttatgcagaccttaccaaccccataagagttactcatttgtacaaccacacaagctcggagattacatctctgtattatgatctccaaggtcaccttattgccatggagttaagcagtggtgaagaatattatgtagcctgtgataatacaggtaccccactagctgtgttcagcagccgaggtcaggtcataaaggagatactatacacaccttatggcgatatctatcatgacacttaccctgactttcaggtcattattggttttcatggaggactctatgatttccttactaaattagtgcacctggggcaaagggattatgatgttgttgctggcagatggacaacgcctaatcatcacatatggaaacagttgaacctccttcctaaaccattcaacctctactcctttgaaaataactacccagttggcaaaattcaagatgttgcaaagtataccacagacatcagaagttggttggagctatttggtttccaattacacaatgtactacctggatttcccaaacctgaattagaaaatttagaattaacttacgagcttctacggcttcagacaaaaactcaagagtgggatcctggaaagactatcctgggcattcagtgtgaactccagaaacagctcaggaatttcatttccttggaccaactacctatgactccccgatacaatgatggacggtgccttgaaggagggaagcaaccaaggtttgctgctgtcccttctgtttttgggaaaggtataaaatttgccatcaaggatggcatagtaacagctgatattataggagtagccaatgaagatagcaggcggcttgctgccattctcaataatgcccattacctggaaaacctacattttaccatagaggggagggacactcactacttcattaagcttgggtctctggaggaagacctggtgctcatcggtaacactggggggaggcggattctggagaatggtgtcaatgtcactgtgtcccagatgacttctgtgttgaatgggaggactagacggtttgcagatattcagctccagcatggagccctgtgcttcaacatccggtatgggacaactgtcgaagaggaaaagaatcacgtgttggagattgccagacagcgcgcagtggcccaggcctggactaaggaacaaagaaggctgcaagagggggaagaggggattagggcatggacagaaggggaaaagcagcagcttttgagcactgggcgggtacaaggttacgatgggtattttgttttgtctgttgagcagtatttagaactttctgacagtgccaataatattcactttatgagacagagcgaaataggcaggaggtaacaaaaatatctctgcctttgcgtcaccaaagactgcctgtttttaaaacataaaatggtttattgtattggttttctagatcagaactctgtatatgtaaatatggaggaaaaacatatccaactgcctttcaatgtgacggaagatggtattttaatattgtttgtttaaactctttaagaaatgacagagatttttagttcttgtgtggcagtattcaaaataacacaagtagaactcaaacagctaaaaacagttttcagaaagcaccactttcaatttgccgagccatgcatatgttccaatatccagaaagaacccaaggttctctatctctattgtgagaagcagtttcatccttaactgttggcagaacttacgggctatttgaataggtggtgcaatagtatctgaaacttgcctttcgaaagactgccagccctttgacgttttccagatctgttataggaaacttaaaaacaggtgtaaaatgtcttcagccaccatctcctagagtgaggacccaattgcccttccttcttgattattcctccttgcttgttaaagtaaatgccatattgttgtgctgtgttttggcgtgtggtggctgggttctgtctaccatgcttccctgtgggtgtggtaaccagactgtatagccgctatttgctcgtgtgtacatgataccaaagcagctggccagcgtgacctctctcacacgacctgttttgactcaattttttactaaaagttgttcagctgtattggtatcatgtaaacatagcttttattaacctgggtaggaatttctcatttatatataggatgtgttttggtcatagtttcacattagtgattcagtatctatacactgacccaatggttttgtgcacatgaacggtaatttacttaaaagtatgattctggtacaaaaacaaacaaaggctttagcaggcatacgtgtctgggatgccgatacatacattaactactactgcagaaattcataagagccaaaaccttaaaaaaatagacctggtacttaagtgaaagtactaaagggaagaccagaccaaacatcacagcagttgctgccacattgtttcagcccacttagatttatctttcaaatgtacaattctgtattgaacatctcccagccatcttcaggaaatcgaatcaagtaaatcctttccaaccgaaaacatttcaactaactatagagaggcagactcatttttactaaaataatttatacagttagttattttcgttctccgtacttacccatttatctttatttaatcgtctctactgcctaggaaaataactattttccaggacgggttatttgttctgcgatcatttaaaatttggagaaaggtcaggattagtgttaatatcagctgcagtttctcaatctctaggaatcctgcagtaaaacaagccccttggtgagctggaagatttgtgcccagtgacaaagagatagtttgtaaaatgctgtgtaattgtaagttaccacaaatgaaaatacatgacagcacaatgtggcccgtagaaaattcccctgagccagcttctgcactttcatcaccgaatctgaacatttgctatgtctgaaggcaaatttatgatggaatgttagtttggattctttccagatgctacctaaatgcagtgtggggtcattgccttgctttgcgatgacagtttctttgaaaatatgcaaagtcataagctcatgttaaggtttttcaagagtctgcctcctactacacaaaggaaagcaagggaaaggaaatgaccctggcaaacagtagggaagggtgtattcaaacatttcattttcaaaaccttcgggttagaataccacttacacatgtattctgagagacagaattcatgaggaactcatctctctttataactggaaacacaccagcttgatatattgctaatccatactaaaatcatattattgggttttttctgaatcaggcctgtattaatggtacagtatttattcagaatggaattctaaaattactaacaaacttgttgaaaatttgaatacctccacaccaacctaaaaatggaccttaagttcctagaacctctgatgttcttttaaattaatggaaaaataatttgtgaactgtatatagagagtgcattcataaatgtgattatgtattttatcacaaatccaaaatgtcaatattagagtctattttgcttatattttaagcaattatacgtttttgcaattcattgatgatgtatcattttcaaactgctttaaatatccattagaaacaaatatttgaagcttttacttaatagtgattaccttgaactgtgcatttctagtttgtaatacgtatttggttggttcgtgcctttagtttgttaaagttacatttgtattatattcaggaaatgcactttttattacttacagctgtggttttaatactgccttgaactattattattctttttacaactcctaaagcttgagggaggaaagaaaaaaaaaacaaaactactaatcagtagtaaatcgaagagaaacattttggcatttcttaagaagaagatggagatattgagtatatcacttcctattcagctgaatagaaagaatgccttcattgacttgcagttctgcagtttaaattattgaaagaacaattcgtttgcatttcctgatgaaagtaaaagcatttttcagagaaacatatgaatttctcatacccagcagacagatggctgacactgcacagccacacaccattcgagtaagttaaagtgagagcatagtagttggactctcctatgaagaacattctgggctggaggcagggaatactccatggttgtttctttttcctacttaagcccattttgtttgtgcttttctgttttgttttgttttcactcttgcactacagtctagagatccaaatgaactgaaaagttcaaagtttaacacatttaaatatgtttacttttagttgtcattctaatcgttattgattagaagcatgactcctgaaggaaagggaaataaatctcaattcatactaacttgcaacaaaacacttttaccatataaataagtatatgatttatttttaacccaaaaaatgtataaaataagtgtgtcctttactgtcaatttatctagaagatctataatatatagactacatatatataatatatacaacatagccaaatgtatgaaaacttgacaatgtataatttggaattcacatgctacctatgtagacaggtatgaaattaagttataattttcatgagacattttcatcactgttgacacagtttcaagcattccatcatgttattttgactctttttcttttttttttctttaaaaatatatttttaactagaccaggccccactataatatcacttaagagagtcagggcaaagtttttgcatttatgaagatgtgttcatgtaagggtgattgtaatggagttcattggtaatagaagcaaaagtacagtaacgaagtattgaaaagaaaattttggagacattggagcatattatatatagcttgtggaaagacataaggctacagatggaatggaacattcctgttttcttgaagaaattcacatacacatagctgacctgactagtacttcagctcttccacagccttctataaaggttctttcttctgcaaagaaaacaaaacaaaacaaaacaaaacaaaaaaaacaaaaaaagcgcaaaaaacaaaaaaacaaaaaaaagcaaagtaaaatttaaaaatacagaaaacaaacaacaaaaaagaattcaaccataaatagtgactattattttcagtgtgtccttcatgtgaaagctattaaggaccaaatatactactgttcataagaagaaattactttctaaacagtaactgaaaatacttagagttaaacttgctgtggattttgtcttggcagttgtcatcttacattatttgtcaaaggaaatgtgtttggcagttaaaaatctttccttagatttagtggtggactttaacctcttaaataaatgttagtatatcagattgtgtccttgaaaaatattttacttgtatgaatcatgacaacgtctaaatctttactattcttctggcaaaagcatcagtaagaaagaaggcgaaaaagagaagtatagcctttatgtcagaaaaacattctttttagctgcttactttctcatgaaaagtaaagatgtttacagtgtatgccaagttttcagtttctgtataacaacaggtagaggttctaatcatattgaaaattgtgttataatggtctgagccatgttgctaggaaacaataggttccaattttgtattcctgctctcctgtgctgaaaagtgactggatactgtacaggttcatgttctctggctgcagttaaatggtcttttgcattttgctctggctttcaggccagaagcatgcatttttctacaagagcatcacaacaacatgctgtaaatatttaaagttaaacattatgtgttgatatttgaaagaaaagtactttgaatatttcatttttaaaaaataaaattgccaatg

SEQ ID NO: 190087 - DNA, 9144 bp, Homo sapiens
  Payload ID: 17535
  Gene Symbol: TENM2
  Gene Name: teneurin transmembrane protein 2
  ENST ID: ENST00000403607
  CDS Start-End: 1-7797
ggtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagcaatgcatctgctcggactcaattggcaactccagcctgcagatgggcacacctttaacaatgggataaggaccggcttaccaggaaacgatgatgtggcaacaatgccatctggaggcaaagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctagattcagtgcaggactgtccacgtaactgccatgggaatggtgaatgtgtgtccggggtgtgtcactgtttcccaggatttctaggagcagactgtgctaaagctgcctgccctgtcctgtgcagtgggaatggacaatattctaaagggacgtgccagtgctacagcggctggaaaggtgcagagtgcgacgtgcccatgaatcagtgcatcgatccttcctgcgggggccacggctcctgcattgatgggaactgtgtctgctctgctggctacaaaggcgagcactgtgaggaagttgattgcttggatcccacctgctccagccacggagtctgtgtgaatggagaatgcctgtgcagccctggctggggtggtctgaactgtgagctggcgagggtccagtgcccagaccagtgcagtgggcatggcacgtacctgcctgacacgggcctctgcagctgcgatcccaactggatgggtcccgactgctctgttgaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattgatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcagcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgaaataaagagtttaaacatagcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaaaacaaaacaaaacaaacacacggaccaataaacaaagaagcgaagataagaaagaaggcctcatatccaattacctcactcattcacatgtgagcgacacgcagacatccgcgagggccagcgtcaccagaccagctgcgggacaaaccactcagactgcttgtaggacaaatacttctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagtctgtttagattccgtagttcgtgggtatcagtttcggtagaggtgcagcatcgtgacacttttgctaacaggtaccacttctgatcaccctgtacatacatgagccgaaaggcacaatcactgtttcagatttaaaattattagtgtgtttgtttggtccagaaactgagacaatcacatgacagtcaccacgaggagagaaaatttaaaaaataaaaataaaaacaaaaaaaattttaaaaattaaaaaaacaaaaataaagtctaataagaactttggtacaggaacttttttgtaatatacatgtatgaattgttcatcgagtttttatattaattttaatttgctgctaagcaaagactagggacaggcaaagataatttatggcaaagtgtttaaattgtttatacataaataaagtctctaaaactcctgtgga

SEQ ID NO: 190088 - DNA, 8034 bp, Homo sapiens
  Payload ID: 17535
  Gene Symbol: TENM2
  Gene Name: teneurin transmembrane protein 2
  ENST ID: ENST00000520394
  CDS Start-End: 52-7659
tagttagagggaaacacaaaacgaagagcggcccactcccagcttacgccgatggtgagcccacctctcctgatcattagcgttgctggcacaattgaatgcaagccagatcatctcttatggagacccggcagtacctcacctcagtctgtgagttttctccatgggaaggttgtgatggagtctctgggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctagattcagtgcaggactgtccacgtaactgccatgggaatggtgaatgtgtgtccggggtgtgtcactgtttcccaggatttctaggagcagactgtgctaaagctgcctgccctgtcctgtgcagtgggaatggacaatattctaaagggacgtgccagtgctacagcggctggaaaggtgcagagtgcgacgtgcccatgaatcagtgcatcgatccttcctgcgggggccacggctcctgcattgatgggaactgtgtctgctctgctggctacaaaggcgagcactgtgaggaagttgattgcttggatcccacctgctccagccacggagtctgtgtgaatggagaatgcctgtgcagccctggctggggtggtctgaactgtgagctggcgagggtccagtgcccagaccagtgcagtgggcatggcacgtacctgcctgacacgggcctctgcagctgcgatcccaactggatgggtcccgactgctctgttgaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattggtaggcaaacggcaggcaccgaaacagatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcagcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaa

SEQ ID NO: 190089 - DNA, 9427 bp, Homo sapiens
  Payload ID: 17535
  Gene Symbol: TENM2
  Gene Name: teneurin transmembrane protein 2
  ENST ID: ENST00000519204
  CDS Start-End: 119-8080
atgcttttccttcccagctggagaaggcctcagctgtgtcagactgggactgctggtgatttttctgtagttagagggaaacacaaaacgaagagcggcccactcccagcttacgccgatggtgagcccacctctcctgatcattagcgttgctggcacaattgaatgcaagccagatcatctcttatggagacccggcagtacctcacctcagtctgtgagttttctccatgggaaggttgtgatggagtctctgggtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagcaatgcatctgctcggactcaattggcaactccagcctgcagatgggcacacctttaacaatgggataaggaccggcttaccaggaaacgatgatgtggcaacaatgccatctggaggcaaagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctagattcagtgcaggactgtccacgtaactgccatgggaatggtgaatgtgtgtccggggtgtgtcactgtttcccaggatttctaggagcagactgtgctaaagctgcctgccctgtcctgtgcagtgggaatggacaatattctaaagggacgtgccagtgctacagcggctggaaaggtgcagagtgcgacgtgcccatgaatcagtgcatcgatccttcctgcgggggccacggctcctgcattgatgggaactgtgtctgctctgctggctacaaaggcgagcactgtgaggaagttgattgcttggatcccacctgctccagccacggagtctgtgtgaatggagaatgcctgtgcagccctggctggggtggtctgaactgtgagctggcgagggtccagtgcccagaccagtgcagtgggcatggcacgtacctgcctgacacgggcctctgcagctgcgatcccaactggatgggtcccgactgctctgttgaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattggtaggcaaacggcaggcaccgaaacagatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcagcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgaaataaagagtttaaacatagcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaaaacaaaacaaaacaaacacacggaccaataaacaaagaagcgaagataagaaagaaggcctcatatccaattacctcactcattcacatgtgagcgacacgcagacatccgcgagggccagcgtcaccagaccagctgcgggacaaaccactcagactgcttgtaggacaaatacttctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagtctgtttagattccgtagttcgtgggtatcagtttcggtagaggtgcagcatcgtgacacttttgctaacaggtaccacttctgatcaccctgtacatacatgagccgaaaggcacaatcactgtttcagatttaaaattattagtgtgtttgtttggtccagaaactgagacaatcacatgacagtcaccacgaggagagaaaatttaaaaaataaaaataaaaacaaaaaaaattttaaaaattaaaaaaacaaaaataaagtctaataagaactttggtacaggaacttttttgtaatatacatgtatgaattgttcatcgagtttttatattaattttaatttgctgctaagcaaagactagggacaggcaaagataatttatggcaaagtgtttaaattgtttatacataaataaagtctctaaaactcctgtgga

SEQ ID NO: 190090 - DNA, 8550 bp, Homo sapiens
  Payload ID: 17535
  Gene Symbol: TENM2
  Gene Name: teneurin transmembrane protein 2
  Uniprot ID: Q9NT68
  ENST ID: ENST00000518659
  CDS Start-End: 40-8364
cttttctgaaaacatcagcattctgccatatctggaataatggatgtaaaggaccggcgacaccgctctttgaccagaggacgctgtggcaaagagtgtcgctacacaagctcctctctggacagtgaggactgccgcgtgcccacacagaaatcctacagctccagtgagactctgaaggcctatgaccatgacagcaggatgcactatggaaaccgagtcacagacctcatccaccgggagtcagatgagtttcctagacaaggaaccaacttcacccttgccgaactgggcatctgtgagccctccccacaccgaagcggctactgctccgacatggggatccttcaccagggctactcccttagcacagggtctgacgccgactccgacaccgagggagggatgtctccagaacacgccatcagactgtggggcagagggataaaatccaggcgcagttccggcctgtccagtcgtgaaaactcggcccttaccctgactgactctgacaacgaaaacaaatcagatgatgagaacggtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagcaatgcatctgctcggactcaattggcaactccagcctgcagatgggcacacctttaacaatgggataaggaccggcttaccaggaaacgatgatgtggcaacaatgccatctggaggcaaagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctagattcagtgcaggactgtccacgtaactgccatgggaatggtgaatgtgtgtccggggtgtgtcactgtttcccaggatttctaggagcagactgtgctaaagctgcctgccctgtcctgtgcagtgggaatggacaatattctaaagggacgtgccagtgctacagcggctggaaaggtgcagagtgcgacgtgcccatgaatcagtgcatcgatccttcctgcgggggccacggctcctgcattgatgggaactgtgtctgctctgctggctacaaaggcgagcactgtgaggaagttgattgcttggatcccacctgctccagccacggagtctgtgtgaatggagaatgcctgtgcagccctggctggggtggtctgaactgtgagctggcgagggtccagtgcccagaccagtgcagtgggcatggcacgtacctgcctgacacgggcctctgcagctgcgatcccaactggatgggtcccgactgctctgttgaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattggtaggcaaacggcaggcaccgaaacagatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcagcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgaaataaagagtttaaacatagcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctga

SEQ ID NO: 190091 - DNA, 8173 bp, Homo sapiens
  Payload ID: 17535
  Gene Symbol: TENM2
  Gene Name: teneurin transmembrane protein 2
  ENST ID: ENST00000545108
  CDS Start-End: 1-7824
ggtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagcaatgcatctgctcggactcaattggcaactccagcctgcagatgggcacacctttaacaatgggataaggaccggcttaccaggaaacgatgatgtggcaacaatgccatctggaggcaaagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctagattcagtgcaggactgtccacgtaactgccatgggaatggtgaatgtgtgtccggggtgtgtcactgtttcccaggatttctaggagcagactgtgctaaagctgcctgccctgtcctgtgcagtgggaatggacaatattctaaagggacgtgccagtgctacagcggctggaaaggtgcagagtgcgacgtgcccatgaatcagtgcatcgatccttcctgcgggggccacggctcctgcattgatgggaactgtgtctgctctgctggctacaaaggcgagcactgtgaggaagttgattgcttggatcccacctgctccagccacggagtctgtgtgaatggagaatgcctgtgcagccctggctggggtggtctgaactgtgagctggcgagggtccagtgcccagaccagtgcagtgggcatggcacgtacctgcctgacacgggcctctgcagctgcgatcccaactggatgggtcccgactgctctgttgaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattgcaaggcagactggaggcagggagaccaatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcagcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgaaataaagagtttaaacatagcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacg

SEQ ID NO: 190092 - DNA, 10263 bp, Homo sapiens
  Payload ID: 17536
  Gene Symbol: TENM3
  Gene Name: teneurin transmembrane protein 3
  ENST ID: ENST00000406950
  CDS Start-End: 1-7590
gagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttatagcaatgcatctctttggcctcaactggcagctacagcagactgaaaatgacacatttgagaatggaaaagtgaattctgataccatgccaacaaacactgtgtcattaccttctggagacaatggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttatagagtctgtggtggaatgtccccgaaattgccatggaaatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcttgtgcttgcaactcaggatacaaaggagaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcgagggttgtcctggtctgtgcaacagcaatggaagatgtaccctggaccaaaatggctggcattgtgtgtgccagcctggatggagaggagcaggctgtgacgtagccatggagactctttgcacagatagcaaggacaatgaaggagatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatgacattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactatgtgcggcggatattcccttctggaaatgtaacaagtgtcttagaactaagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtgtacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttattaatggattttacaatgctaacgtggtttcccttcggggaaaaaactggcaactagaatccttgtcactgataagcaaaggaaatcctgatttttttgtaaattatgtgagacaagttgtttatggatttttatatgaattacaatttactgtacatcaaatcttagtctcagaggagttaatttatgtaaagtgtttaaaaatttatacttaaaaataaaatgataaaaacgtgaactgtgtgatttttttaaaaggattgcaccttttgttatctgttatagctgtacagtatgaattattatattgtagagatataacaacttatgcctataatgtccagaagtgttaatatttttgtattaggttgaaaaaatgtgcaagcttctatcactagatggataggaccgtgcaattctaggtgggtggcgaatcagagagctcctttctcttccctctctcacgcatcaggccagtgtcctcagcattgtcaactgagaggcacagtagacaactagggctggtggaatgtaagggaagaagattgaaaaaacgggaggaagggttctctggccctctctcaaccttgcaagtcaatggggagttgttgatataattaaccccgaggtttttactgttactgttccaaagctctgtctcttgatggaggagagaccacatcagatgctggggaaataggaggaggaaaggttctgatgtagtcgtgatcctaaacacgtgtcttaagatctaggaaagacagcagaaaccgagcagtggtgggtgagccagatggagccggtcagggttactctaagcccacatgaccaaaccatcttggggggctggtttgaatgacagcctctgctctgtctcggggaagccgggggtggcagatccagctggaagtgaactgacagccgcgccctcctgcacacatgcatgcacgcgtgtgggaacgagcccagccgccatctgcacttccgtgtcggctcagctctgacaaatctctttcctgagcactaaattcagccacgaaaatatttttagaagatatttctcagttcatcgagctatagtacacactgttttcctctatgtataatggtgataaaatatagcaagtgaacatgtcgtaaatataaaggttcaagtgatgtattgaaaataattttctaactgctttgtatgtatcacatactctaaattgcacagtaggcgtgtttattaaacagatgattggctgggaaagtttcaaaatagctactgaatttacagtatcagtgctattactgtctttgtgtatttggtagagcataccgaagtaattaatcttctaatgaatgctgatgatattttattagaatgaaagcacagattagcattaatattttttattctggaaatcctttggcaagtattatgaagcccaaatttagaaaactatgagatttcaaaccacataaacatgattctgttttccattttattttttaactgttaggtatttgcagttctgttccgtggaacttctgcaggcctgtatttagcatgctgtaagtacttttgggtgaaataggctctgagtctaaattctcagacatgtttctgatgtattaccatgaaaagcttgtgccacatgacagaagtgagatcatagtcttaacctcttcttgacgtggactggtcttcactcgggcaccgataaataacagatttggagtatctcctggtgcttattttagatgatgaagtcaaatcaacccaattagtgtcctgttagtaggtataatgagcctatttctttctaaaaagacttgtgatctggacatgcttttacaagaaatagtgaccttggggaatatgtaaacaaaagacctttttctaagagttgggagggggtgggggactgtataatgaaaagaattagcttacaaaaaagaaattgatattcaaagtattttaggcaaagccagtcaaaatgctttcatgatattttgagatgtaaattttgtctgatttgtattgttcttttcatttgccttcttaactttatatgtgacctgaattttccataacttgatgactatagattgcacctaggcattccaataaaagccaacccaatgtg

SEQ ID NO: 190093 - DNA, 651 bp, Homo sapiens
  Payload ID: 17536
  Gene Symbol: TENM3
  Gene Name: teneurin transmembrane protein 3
  ENST ID: ENST00000512480
  CDS Start-End: 141-651
cggctcgggcggacgcggcggctgctgccggggagcgagccggcggcgcgggcgagccgagcgcgagaggccaatgagacttgaaccctgagcctaagttgtcaccagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggacagaattttaccctaaggcagttaggagtttgtgaaccagcaactcgaagaggactggcattttgtgcggaaatggggctccctcacagaggttactctatcagtgcagggtcagatgctgatactgaaaatgaagcagtgatgtccccagagcatgccatgagactttggggcaggggggtcaaatcaggccgcagctcctgcctgtcaagtcggtccaactcagccctcaccctgacagatacggagcacgaaaacaagtccgacagtgagaatg

SEQ ID NO: 190094 - DNA, 10896 bp, Homo sapiens
  Payload ID: 17536
  Gene Symbol: TENM3
  Gene Name: teneurin transmembrane protein 3
  Uniprot ID: Q9P273
  ENST ID: ENST00000511685
  CDS Start-End: 124-8223
atgggtctggagcttggaggagaagtctgaactaaggataaactaaagagaggccaatgagacttgaaccctgagcctaagttgtcaccagcaggactgatgtgcacacagaaggaatgaagtatggatgtgaaagaacgcaggccttactgctccctgaccaagagcagacgagagaaggaacggcgctacacaaattcctccgcagacaatgaggagtgccgggtacccacacagaagtcctacagttccagcgagacattgaaagcttttgatcatgattcctcgcggctgctttacggcaacagagtgaaggatttggttcacagagaagcagacgagttcactagacaaggacagaattttaccctaaggcagttaggagtttgtgaaccagcaactcgaagaggactggcattttgtgcggaaatggggctccctcacagaggttactctatcagtgcagggtcagatgctgatactgaaaatgaagcagtgatgtccccagagcatgccatgagactttggggcaggggggtcaaatcaggccgcagctcctgcctgtcaagtcggtccaactcagccctcaccctgacagatacggagcacgaaaacaagtccgacagtgagaatgagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttatagcaatgcatctctttggcctcaactggcagctacagcagactgaaaatgacacatttgagaatggaaaagtgaattctgataccatgccaacaaacactgtgtcattaccttctggagacaatggaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttatagagtctgtggtggaatgtccccgaaattgccatggaaatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcttgtgcttgcaactcaggatacaaaggagaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcgagggttgtcctggtctgtgcaacagcaatggaagatgtaccctggaccaaaatggctggcattgtgtgtgccagcctggatggagaggagcaggctgtgacgtagccatggagactctttgcacagatagcaaggacaatgaaggagatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatgacattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactatgtgcggcggatattcccttctggaaatgtaacaagtgtcttagaactaagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaactttaaaaaagaaaaaaaaatgtgtacagtgtttccaaatagtcccgaattgtcgacctttgcttacaagaagtagtctgtctgcataggatgtgatagctatctctgttcattttacaatgtggggcaaagttactgtttctagacaacccaactgctttccctgtgcagctttgtagaaggacattggcacagtgacttctgcggcggggatttattaatggattttacaatgctaacgtggtttcccttcggggaaaaaactggcaactagaatccttgtcactgataagcaaaggaaatcctgatttttttgtaaattatgtgagacaagttgtttatggatttttatatgaattacaatttactgtacatcaaatcttagtctcagaggagttaatttatgtaaagtgtttaaaaatttatacttaaaaataaaatgataaaaacgtgaactgtgtgatttttttaaaaggattgcaccttttgttatctgttatagctgtacagtatgaattattatattgtagagatataacaacttatgcctataatgtccagaagtgttaatatttttgtattaggttgaaaaaatgtgcaagcttctatcactagatggataggaccgtgcaattctaggtgggtggcgaatcagagagctcctttctcttccctctctcacgcatcaggccagtgtcctcagcattgtcaactgagaggcacagtagacaactagggctggtggaatgtaagggaagaagattgaaaaaacgggaggaagggttctctggccctctctcaaccttgcaagtcaatggggagttgttgatataattaaccccgaggtttttactgttactgttccaaagctctgtctcttgatggaggagagaccacatcagatgctggggaaataggaggaggaaaggttctgatgtagtcgtgatcctaaacacgtgtcttaagatctaggaaagacagcagaaaccgagcagtggtgggtgagccagatggagccggtcagggttactctaagcccacatgaccaaaccatcttggggggctggtttgaatgacagcctctgctctgtctcggggaagccgggggtggcagatccagctggaagtgaactgacagccgcgccctcctgcacacatgcatgcacgcgtgtgggaacgagcccagccgccatctgcacttccgtgtcggctcagctctgacaaatctctttcctgagcactaaattcagccacgaaaatatttttagaagatatttctcagttcatcgagctatagtacacactgttttcctctatgtataatggtgataaaatatagcaagtgaacatgtcgtaaatataaaggttcaagtgatgtattgaaaataattttctaactgctttgtatgtatcacatactctaaattgcacagtaggcgtgtttattaaacagatgattggctgggaaagtttcaaaatagctactgaatttacagtatcagtgctattactgtctttgtgtatttggtagagcataccgaagtaattaatcttctaatgaatgctgatgatattttattagaatgaaagcacagattagcattaatattttttattctggaaatcctttggcaagtattatgaagcccaaatttagaaaactatgagatttcaaaccacataaacatgattctgttttccattttattttttaactgttaggtatttgcagttctgttccgtggaacttctgcaggcctgtatttagcatgctgtaagtacttttgggtgaaataggctctgagtctaaattctcagacatgtttctgatgtattaccatgaaaagcttgtgccacatgacagaagtgagatcatagtcttaacctcttcttgacgtggactggtcttcactcgggcaccgataaataacagatttggagtatctcctggtgcttattttagatgatgaagtcaaatcaacccaattagtgtcctgttagtaggtataatgagcctatttctttctaaaaagacttgtgatctggacatgcttttacaagaaatagtgaccttggggaatatgtaaacaaaagacctttttctaagagttgggagggggtgggggactgtataatgaaaagaattagcttacaaaaaagaaattgatattcaaagtattttaggcaaagccagtcaaaatgctttcatgatattttgagatgtaaattttgtctgatttgtattgttcttttcatttgccttcttaactttatatgtgacctgaattttccataacttgatgactatagattgcacctaggcattccaataaaagccaacccaatgtg

SEQ ID NO: 190095 - DNA, 548 bp, Homo sapiens
  Payload ID: 17536
  Gene Symbol: TENM3
  Gene Name: teneurin transmembrane protein 3
  ENST ID: ENST00000510504
  CDS Start-End: 1-548
gtaacacgatacgctccagacccaggcaacttggcagcgctgggctcggttcctcacggccacagcgagggcgcgccgcggcaagagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcct

SEQ ID NO: 190096 - DNA, 14000 bp, Homo sapiens
  Payload ID: 17537
  Gene Symbol: TENM4
  Gene Name: teneurin transmembrane protein 4
  Uniprot ID: Q6N022
  ENST ID: ENST00000278550
  CDS Start-End: 464-8773
acctgctccttcctgggcgccccgctacggctcgcggagcagaggagccgcgccgccgagagagagaggagccaccggcgcggcgccttgcctccctgccgccgtcctcgccgcttccccggcggtagcagcctgcagccacgatggaaaaactgagaatcagagagggctagtgatctctcagacacttggtcggtagaaaagatcccgcaccatcctccaggatccaatggccttggagagagggctgcagggcccacggacattgctgactcttcagaacgtgctgacatggagccaggtagactgaaattaccatgtgtccaaattaaaattgcatacttcaaggattatttgaaggactattcttagacccttttaagaagatttaaagaaaaaccactcggccctgagtgcggcgaggaccctgtttgtggatgtggaggagcgcgggccggaggccatggacgtgaaggagaggaagccttaccgctcgctgacccggcgccgcgacgccgagcgccgctacaccagctcgtccgcggacagcgaggagggcaaagccccgcagaaatcgtacagctccagcgagaccctgaaggcctacgaccaggacgcccgcctagcctatggcagccgcgtcaaggacattgtgccgcaggaggccgaggaattctgccgcacaggtgccaacttcaccctgcgggagctggggctggaagaagtaacgccccctcacgggaccctgtaccggacagacattggcctcccccactgcggctactccatgggggctggctctgatgccgacatggaggctgacacggtgctgtcccctgagcaccccgtgcgtctgtggggccggagcacacggtcagggcgcagctcctgcctgtccagccgggccaattccaatctcacactcaccgacaccgagcatgaaaacactgagactgatcatccgggcggcctgcagaaccacgcgcggctccggacgccgccgccgccgctctcgcacgcccacacccccaaccagcaccacgcggcctccattaactccctgaaccggggcaacttcacgccgaggagcaaccccagcccggcccccacggaccactcgctctccggagagccccctgccggcggcgcccaggagcctgcccacgcccaggagaactggctgctcaacagcaacatccccctggagaccagaaacctaggcaagcagccattcctagggacattgcaggacaacctcattgagatggacattctcggcgcctcccgccatgatggggcttacagtgacgggcacttcctcttcaagcctggaggcacctccccgctcttctgcaccacatcaccagggtacccactgacgtccagcacagtgtactctcctccgccccgacccctgccccgcagcaccttcgcccggccggcctttaacctcaagaagccctccaagtactgtaactggaagtgcgcagccctgagcgccatcgtcatctcagccactctggtcatcctgctggcatactttgtggccatgcacctgtttggcctaaactggcacctgcagccgatggaggggcagatgtatgagatcacggaggacacagccagcagttggcctgtgccaaccgacgtctccctatacccctcagggggcactggcttagagacccctgacaggaaaggcaaaggaaccacagaaggaaagcccagtagtttctttccagaggacagtttcatagattctggagaaattgatgtgggaaggcgagcttcccagaagattcctcctggcactttctggagatctcaagtgttcatagaccatcctgtgcatctgaaattcaatgtgtctctgggaaaggcagccctggttggcatttatggcagaaaaggcctccctccttcacatacacagtttgactttgtggagctgctggatggcaggaggctcctaacccaggaggcgcggagcctagaggggaccccgcgccagtctcggggaactgtgcccccctccagccatgagacaggcttcatccagtatttggattcaggaatctggcacttggctttttacaatgacggaaaggagtcagaagtggtttcctttctcaccactgccattgagtcggtggataactgccccagcaactgctatggcaatggtgactgcatctctgggacctgccactgcttcctgggtttcctgggccccgactgtggcagagcctcctgccccgtgctctgtagcggaaatggccaatacatgaaaggcagatgcttgtgccacagtggctggaaaggcgctgagtgcgatgtgcccaccaaccagtgtatcgatgtggcctgcagcaaccatggcacctgcatcacgggcacctgcatctgcaaccctggctacaagggcgagagctgtgaggaagtggactgcatggaccccacatgttcaggccggggtgtctgcgtgagaggcgaatgccactgctctgtgggatggggaggcaccaactgcgagacccccagggccacatgcttagaccagtgttcaggccacggaaccttcctcccggacaccgggctttgcagctgtgacccaagctggactggacacgactgttctatcgagatctgtgctgccgactgtggtggccatggcgtgtgcgtagggggcacctgccgctgcgaggatggctggatgggggcagcctgcgaccagcgggcctgccacccgcgctgtgccgagcatgggacctgccgcgacggcaagtgcgagtgcagccctggctggaatggcgaacactgcaccatcgctcactatctggatagggtagttaaagagggttgccctgggttgtgcaatggcaacggcagatgtaccttagacctgaatggttggcactgcgtctgccagctgggctggagaggagctggctgtgacacttccatggagactgcctgcggtgacagcaaagacaatgatggagatggcctggtggactgcatggaccctgactgctgcctccagcccctgtgccatatcaacccgctgtgccttggctcccctaaccctctggacatcatccaggagacacaggtccctgtgtcacagcagaacctacactccttctatgaccgcatcaagttcctcgtgggcagggacagcacgcacataatccccggggagaacccctttgatggagggcatgcttgtgttattcgtggccaagtgatgacatcagatggaacccccctggttggtgtgaacatcagttttgtcaataaccctctctttggatatacaatcagcaggcaagatggcagctttgacttggtgacaaatggcggcatctccatcatcctgcggttcgagcgggcacctttcatcacacaggagcacaccctgtggctgccatgggatcgcttctttgtcatggaaaccatcatcatgagacatgaggagaatgagattcccagctgtgacctgagcaattttgcccgccccaacccagtcgtctctccatccccactgacgtccttcgccagctcctgtgcagagaaaggccccattgtgccggaaattcaggctttgcaggaggaaatctctatctctggctgcaagatgaggctgagctacctgagcagccggacccctggctacaaatctgtcctgaggatcagcctcacccacccgaccatccccttcaacctcatgaaggtgcacctcatggtagcggtggagggccgcctcttcaggaagtggttcgctgcagccccagacctgtcctattatttcatttgggacaagacagacgtctacaaccagaaggtgtttgggctttcagaagcctttgtttccgtgggttatgaatatgaatcctgcccagatctaatcctgtgggaaaaaagaacaacagtgctgcagggctatgaaattgacgcgtccaagcttggaggatggagcctagacaaacatcatgccctcaacattcaaagtggcatcctgcacaaagggaatggggagaaccagtttgtgtctcagcagcctcctgtcattgggagcatcatgggcaatgggcgccggagaagcatctcctgccccagctgcaacggccttgctgacggcaacaagctcctggccccagtggccctcacctgtggctctgacgggagcctctatgtgggtgatttcaactacattagaaggatcttcccctctggaaatgtcaccaacatcctagagctgagaaataaagatttcagacatagtcacagtccagcacacaaatactacctggccacagaccccatgagtggggccgtcttcctttctgacagcaacagccggcgggtctttaaaatcaagtccactgtggtggtgaaggaccttgtcaagaactctgaggtggttgcggggacaggtgaccagtgcctcccctttgatgacactcgctgcggggatggtgggaaggccacagaagccacactcaccaatcccaggggcattacagtggacaagtttgggctgatctacttcgtggatggcaccatgatcagacgcatcgatcagaatgggatcatctccaccctgctcggctctaatgatctcacatcagcccggccactcagctgtgattctgtcatggatatttcccaggttcacctggagtggcccacagacttagccatcaacccaatggacaactcactttatgtcctcgacaacaatgtggtcctgcaaatctctgaaaaccaccaggtgcgcattgtcgccgggaggcccatgcactgccaggtccctggcattgaccacttcctgctaagcaaggtggccatccacgcaaccctggagtcagccaccgctttggctgtttcacacaatggggtcctgtatattgctgagactgatgagaaaaagatcaaccgcatcaggcaggtcaccactagtggagagatctcactcgttgctggggcccccagtggctgtgactgtaaaaatgatgccaactgtgattgtttttctggagacgatggttatgccaaggatgcaaagttaaataccccatcttccttggctgtgtgtgctgatggggagctctacgtggccgaccttgggaacatccgaattcggtttatccggaagaacaagcctttcctcaacacccagaacatgtatgagctgtcttcaccaattgaccaggagctctatctgtttgataccaccggcaagcacctgtacacccaaagcctgcccacaggagactacctgtacaacttcacctacactggggacggcgacatcacactcatcacagacaacaatggcaacatggtaaatgtccgccgagactctactgggatgcccctctggctggtggtcccagatggccaggtgtactgggtgaccatgggcaccaacagtgcactcaagagtgtgaccacacaaggacacgagttggccatgatgacataccatggcaattccggccttctggcaaccaaaagcaatgaaaacggatggacaacattttatgagtacgacagctttggccgcctgacaaatgtgaccttccctactggccaggtgagcagtttccgaagtgatacagacagttcagtgcatgtccaggtagagacctccagcaaggatgatgtcaccataaccaccaacctgtctgcctcaggcgccttctacacactgctgcaagaccaagtccggaacagctactacatcggggccgatggctccttgcggctgctgctggccaacggcatggaggtggcgctgcagactgagccccacttgctggctggcaccgtcaaccccaccgtgggcaagaggaatgtcacgctgcccatcgacaacggcctcaacctggtggagtggcgccagcgcaaagagcaggctcggggccaggtcactgtctttgggcgccggctgcgggttcacaaccgaaatctcctatctctggactttgatcgcgtaacacgcacagagaagatctatgatgaccaccgcaagttcacccttcggattctgtacgaccaggcggggcggcccagcctctggtcacccagcagcaggctgaatggtgtcaacgtgacatactcccctgggggttacattgctggcatccagaggggcatcatgtctgaaagaatggaatacgaccaggcgggccgcatcacatccaggatcttcgctgatgggaagacatggagctacacatacttagagaagtccatggtgctgctactacacagccagaggcagtatatctttgagttcgacaagaatgaccgcctctcttctgtgacgatgcccaacgtggcgcggcagacactagagaccatccgctcagtgggctactacagaaacatctatcagccccctgagggcaatgcctcagtcatacaggacttcactgaggatgggcacctccttcacaccttctacctgggcactggccgcagggtgatatacaagtatggcaaactgtcaaagctggcagagacgctctatgacaccaccaaggtcagtttcacctatgacgagacggcaggcatgctgaagaccatcaacctacagaatgagggcttcacctgcaccatccgctaccgtcagattgggcccctgattgaccgacagatcttccgcttcactgaggaaggcatggtcaacgcccgttttgactacaactatgacaacagcttccgggtgaccagcatgcaggctgtgatcaacgagaccccactgcccattgatctctatcgctatgatgatgtgtcaggcaagacagagcagtttgggaagtttggtgtcatttactatgacattaaccagatcatcaccacagctgtcatgacccacaccaagcattttgatgcatatggcaggatgaaggaagtgcagtatgagatcttccgctcgctcatgtactggatgaccgtccagtatgataacatggggcgagtagtgaagaaggagctgaaggtaggaccctacgccaataccactcgctactcctatgagtatgatgctgacggccagctgcagacagtctccatcaatgacaagccactctggcgctacagctacgacctcaatgggaacctgcacttactgagccctgggaacagtgcacggctcacaccactacggtatgacatccgcgaccgcatcactcggctgggtgacgtgcaatacaagatggatgaggatggcttcctgaggcagcggggcggtgatatctttgagtacaactcagctggcctgctcatcaaggcctacaaccgggctggcagctggagtgtcaggtaccgctacgatggcctggggcggcgcgtgtccagcaagagcagccacagccaccacctgcagttcttctatgcagacctgaccaaccccaccaaggtcacccacctgtacaaccactccagctctgagatcacctccctctactacgacttgcaaggacacctctttgccatggagctgagcagtggtgatgagttttacatagcttgtgacaacatcgggacccctcttgctgtctttagtggaacaggtttgatgatcaagcaaatcctgtacacagcctatggggagatctacatggataccaaccccaactttcagatcatcataggctaccatggtggcctctatgatccactcaccaagcttgtccacatgggccggcgagattatgatgtgctggccggacgctggactagcccagaccacgagctgtggaagcaccttagtagcagcaacgtcatgccttttaatctctatatgttcaaaaacaacaaccccatcagcaactcccaggacatcaagtgcttcatgacagatgttaacagctggctgctcacctttggattccagctacacaacgtgatccctggttatcccaaaccagacatggatgccatggaaccctcctacgagctcatccacacacagatgaaaacgcaggagtgggacaacagcaagtctatcctcggggtacagtgtgaagtacagaagcagctcaaggcctttgtcaccttagaacggtttgaccagctctatggctccacaatcaccagctgccagcaggctccaaagaccaagaagtttgcatccagcggctcagtctttggcaagggggtcaagtttgccttgaaggatggccgagtgaccacagacatcatcagtgtggccaatgaggatgggcgaagggttgctgccatcttgaaccatgcccactacctagagaacctgcacttcaccattgatggggtggatacccattactttgtgaaaccaggaccttcagaaggtgacctggccatcctgggcctcagtggggggcggcgaaccctggagaatggggtcaacgtcactgtgtcccagatcaacacagtacttaatggcaggactagacgctacacagacatccagctccagtacggggcactgtgcttgaacacacgctacgggacaacgttggatgaggagaaggcacgggtcctggagctggcccggcagagagccgtgcgccaagcgtgggcccgcgagcagcagagactgcgggaaggggaggaaggcctgcgggcctggacagagggggagaagcagcaggtgctgagcacagggcgggtgcaaggctacgacggctttttcgtgatctctgtcgagcagtacccagaactgtcagacagcgccaacaacatccacttcatgagacagagcgagatgggccggaggtgacagagaggaccaaggacttcttgccaaagacagctactcttttgtggccgcatacctgactgtgttgtacttttaaaaaaatgattttttaacaagtgcagaaacaaaaagatactggttgcattgtaactcatgcaacatccttttttttagaaaagaaaaacacagatttggccttcgcacattttttgcaaagaacagaaggtatttttttctgtagtgtgatcacaatgaaaactttattgtcttttgttccctttttccttgaggatttttcccttgtcgtttggggtatgtatctcctctctgagatgcatctcctggggtgtgtcctcgtctgtccctaggtacccagtgtgatgtgggacatgaatgtctgtgctaacttgtctcatgtgcaaccctttcttcttcgactggggtcgggcaggagtaaagggagtgatgggccagtacaacaccccttccaagggggcctgggaggagggtctgtaggacctgaggctccttggcagggctcctgcagaagagtggtggatttcttctcaccttgttctctgcctccagaggatcatagatggcttcatcttgctccagggaatttcatggtgttgttcagcaccttttttaagctgccccaaactcctgttcaagctttctattttgatgctgaatgaaaccccctaccacttttgcaaatcctgtgtagttgtcggtgccacccccatgctgggatagagaaagtgtctcccaggtcctttcccccagaccagtgacataacatcctgggctcagagtcccatcctcccgggagggaaagcacccaggatgcctgtgattggttggtcctccatgatgttcctgttcatctcctcctttctcccaaagccagatgtgagaacgagcactgcacagcaagccttcaatgtgggcaccatgtccacagaacagaaggccacccatggcaaaggcatggcagtggtggcgagggcaccagcctgccttccgaggcaaagccctctctctatgactttgagtatcttccctccaccactcagccgccaccactgagacgtaggaatgtggagggaggtgcttggtggcctttgattctggaaaaatgcttaacaaaaaaagccagccaaagagaggaaggcataagctaagcatccttctaaccagttcccaaagtcccatctgcctccatgtaccagctgatcgcagagctggactggggcaggctgggcttccaggaaattcctgaagttctgaaacagcttcccctctagagaagcccacccaatgtgttttttagtgacaggaagaaaggagggaagagctgatgtggtgtggcctgcccatatcatacaaccccaccaggagcagggcagttcccaaggtgggtgcccgtagatctgggaggccaggctggcatgattcctgtgaagaactgtgcctgtgtcgtcagggagaggcctgagccctctcagaagcagggacagcccacacctgaagagcacgcccaagctgaggcagcagccagcaggctgggggagcagtgagggcagggggagtcacagccagagctgggagccccttgttcaaggattccattcctggttcatccgcctaattaccattgtcattaccactcacaggaggctctgggagatgggaggggaagccaaatgcttccttttaagctgggcttcttagaaaatggaacttttatgggttacatttacattaagtgtggaaaatgaattctgagtctgagctattccccgtggaaaccttgttggactgataagctcatggcacctctatagccttactcacatagtcttcagaatattacacaagttaatgaaactgagaaggtctgactgcatgaggatcggagcagcatgtagtctgggttctgcctggcagagggaggcaaccaaaacttcttggggagaggagatttcgccttaacgtcatcccactgggattagaggatgtgtttcgctaagtgctcttcctgtttccaaaaaaaaagccaccctgctgcagcagtgcgctttggcctgcttgtccactggttgcccattgcccctggatccagagctctactgagtcagatacagtgctctgcaggcctgctgtgggaggcatgagctggagatgggggctcccatctggcaggatcattcttggatgagatggaaaacagtttggcctgaagaacacaagttttgtcctccagaagggacttacgcctctcaaaatgtactcttcataccaagggcccttgggcaaagtgctcctgcccagttgatcagtcccatcctggctgcctgacatcagtgaagacctgctggggatgtctgctcagaggtcaggaacggcatgcggtccacaggaaccagctccctacgcttcccccacgccctgtccctcctccacagccccctccccaaaggaatagggtggacttttagggatcaaaaacagaattattgggtgtttcatttatttttttctttctttcttttttttttcatagagatggggtctcactatgttgcccaggctgttctcaaactcctggcctcaggcgatccaccttggcctcctgaagtgctggggttacaggtgtgagccactgcgcctggactgagtgtttgtttctttaaaggatcttatatttttcctgtgctacataccaccacagcagcccagcttctgtggggagagaagttgaaggatcccgaagctttagaaaaaggatctcagctgtggcacaggcagtgttatgcgcctcactgccacattggtgctgttgtattgaaggtggtgcttctggccttggcccttttgagttggtttccatttgggctgcaggtgactcagtgactccctcctcaagctgtcctcctgctaagaccagcagtcacaaacccatggcaagggtgagtgtgaaggcctaaccctgtgcctatgtaataggctccaagcatcgactcccatcctgagaggaccggcccttttgacactcaccaaccaaatctgttcattcgatagagtgaccaggcctccctcacctgcccaggtgtatgatcctacagttcctgccttctctcctaccccgcacagctgccaactggtcctacatcctcagcccctctgccaccaccttaaataggactttactgattccccaactttgtttttttgtaggatgagatttcctttttatcccacccccccacaccccaaacagacattgctggagggcagactggaggaaggggaaggcatgcaggtaaattactgccttgtcagcctctgaccctcatctctcagaattgttggctgagaattaacccaaggaccacaccagtgcctgatttctacttagggagagaggattggaaacgatccctaagaaactgactgagggtgagaatggccaggaggtgtgtgtccaaataaccaggagggggcacagaagatgatggcaaggcagactgggcagtgttttgtagacacagaacaaagaatcagaatttgaaaaaagaagaaaaacaaatcttcgcagctgcaactttaaagtatcacctttatagatggcagggatttccattatgcaaatggaatctaagatttcaatgtgaaatcttagaatgcagttttaccacttgcagtcttgtatttgtggtggccatgtggtgagggcggtgatgctgagctttctgcccaggaggaatgagctttcaagctctcagcagggtgtcaggcttggggatttgagcatccactgctcaaagtccaggctattctccagtcctcacggcagccactaagcccaggagccagacctggcccggggacacatctcctgagggatcccagaaagaacccagtctttcctttcccttggggtccttgttagaatgaaaacctctctatttaaggcacatcattcccagctaggtttatacacttgtctatattttactggaggaaagggaattaaaaaagaactctgcagttcaaggccctttcatttaaccttccaaaaacagcaaactcattttaaagactcattgctgaggtgatagagagaaaccttatcctctccaaccttcacattcacaaaaaccatccttgtgtacttgactgccctagacagtggtgactcttaggtttcattacgaatgtggaatatcagagtgtgggaaggcccaggcgagggccaatgttgtgtttcttaccccctctggaatgccaaaggcaaggtactaggtgacctcctggtccccaagaaaatgtgatttattctgagggcgaacagccaagggaggactagtctggagcacgctcggccgtcctggcaggagctgagcctcaggtgtctggcggtgccccagcagccctggattcacccaacaccagaatcccacttttctaaatccacctgttgttctgagcacctctgaacccgcagcttcggcaaaaggagtctgtaccaagctgcttctggatgaccaacactggagactctggccttaccatgtggaaatcattttcctgaagtctggaactaattttgagaagtttttttctcaacacttttgtgtttctaacactgtatcttgactgtgtaaataccaacaaggctgtaaataaatgcagatgtagataccttctagaaaaaaaaaagcataaaaacaaaaccagaagtgatcccgtgtagccttcgttgacaaataaagactattttgtgtttacaggtgtctggtggcctttgcttggagataaaggcttcctcttgcctgtcccagcccccgagccatcctgggtttgcacttccctgctggctgctatcaggatgacctgggagaggactcagtcctaggccccagggtccctctaaatccctccaggctgcagctctgtcaagagggatgtccagagggtctctaagaccctgaagcttgactttgcaattgcatgacaggaataaatatcacagctcctctgacatcactagtgcagcgtggctccccatcccactgctgccctcgttcagggacaggctgaaggggccaacgaacccaaccctcccagaggagggagccttgctccaccactgggcacacagagtcatccaccatgccactgccttccacaagggatgtgagccgttgcactttaaaaataaatgactgtatattcatca

SEQ ID NO: 190097 - DNA, 3048 bp, Homo sapiens
  Payload ID: 17537
  Gene Symbol: TENM4
  Gene Name: teneurin transmembrane protein 4
  ENST ID: ENST00000530738
  CDS Start-End: 1-2856
aataccccatcttccttggctgtgtgtgctgatggggagctctacgtggccgaccttgggaacatccgaattcggtttatccggaagaacaagcctttcctcaacacccagaacatgtatgagctgtcttcaccaattgaccaggagctctatctgtttgataccaccggcaagcacctgtacacccaaagcctgcccacaggagactacctgtacaacttcacctacactggggacggcgacatcacactcatcacagacaacaatggcaacatggtaaatgtccgccgagactctactgggatgcccctctggctggtggtcccagatggccaggtgtactgggtgaccatgggcaccaacagtgcactcaagagtgtgaccacacaaggacacgagttggccatgatgacataccatggcaattccggccttctggcaaccaaaagcaatgaaaacggatggacaacattttatgagtacgacagctttggccgcctgacaaatgtgaccttccctactggccaggtgagcagtttccgaagtgatacagacagttcagtgcatgtccaggtagagacctccagcaaggatgatgtcaccataaccaccaacctgtctgcctcaggcgccttctacacactgctgcaagaccaagtccggaacagctactacatcggggccgatggctccttgcggctgctgctggccaacggcatggaggtggcgctgcagactgagccccacttgctggctggcaccgtcaaccccaccgtgggcaagaggaatgtcacgctgcccatcgacaacggcctcaacctggtggagtggcgccagcgcaaagagcaggctcggggccaggtcactgtctttgggcgccggctgcgggttcacaaccgaaatctcctatctctggactttgatcgcgtaacacgcacagagaagatctatgatgaccaccgcaagttcacccttcggattctgtacgaccaggcggggcggcccagcctctggtcacccagcagcaggctgaatggtgtcaacgtgacatactcccctgggggttacattgctggcatccagaggggcatcatgtctgaaagaatggaatacgaccaggcgggccgcatcacatccaggatcttcgctgatgggaagacatggagctacacatacttagagaagtccatggtgctgctactacacagccagaggcagtatatctttgagttcgacaagaatgaccgcctctcttctgtgacgatgcccaacgtggcgcggcagacactagagaccatccgctcagtgggctactacagaaacatctatcagccccctgagggcaatgcctcagtcatacaggacttcactgaggatgggcacctccttcacaccttctacctgggcactggccgcagggtgatatacaagtatggcaaactgtcaaagctggcagagacgctctatgacaccaccaaggtcagtttcacctatgacgagacggcaggcatgctgaagaccatcaacctacagaatgagggcttcacctgcaccatccgctaccgtcagattgggcccctgattgaccgacagatcttccgcttcactgaggaaggcatggtcaacgcccgttttgactacaactatgacaacagcttccgggtgaccagcatgcaggctgtgatcaacgagaccccactgcccattgatctctatcgctatgatgatgtgtcaggcaagacagagcagtttgggaagtttggtgtcatttactatgacattaaccagatcatcaccacagctgtcatgacccacaccaagcattttgatgcatatggcaggatgaaggaagtgcagtatgagatcttccgctcgctcatgtactggatgaccgtccagtatgataacatggggcgagtagtgaagaaggagctgaaggtaggaccctacgccaataccactcgctactcctatgagtatgatgctgacggccagctgcagacagtctccatcaatgacaagccactctggcgctacagctacgacctcaatgggaacctgcacttactgagccctgggaacagtgcacggctcacaccactacggtatgacatccgcgaccgcatcactcggctgggtgacgtgcaatacaagatggatgaggatggcttcctgaggcagcggggcggtgatatctttgagtacaactcagctggcctgctcatcaaggcctacaaccgggctggcagctggagtgtcaggtaccgctacgatggcctggggcggcgcgtgtccagcaagagcagccacagccaccacctgcagttcttctatgcagacctgaccaaccccaccaaggtcacccacctgtacaaccactccagctctgagatcacctccctctactacgacttgcaaggacacctctttgccatggagctgagcagtggtgatgagttttacatagcttgtgacaacatcgggacccctcttgctgtctttagtggaacaggtttgatgatcaagcaaatcctgtacacagcctatggggagatctacatggataccaaccccaactttcagatcatcataggctaccatggtggcctctatgatccactcaccaagcttgtccacatgggccggcgagattatgatgtgctggccggacgctggactagcccagaccacgagctgtggaagcaccttagtagcagcaacgtcatgccttttaatctctatatgttcaaaaacaacaaccccatcagcaactcccaggacatcaagtgcttcatgacagagaggaccaaggacttcttgccaaagacagctactcttttgtggccgcatacctgactgtgttgtacttttaaaaaaatgattttttaacaagtgcagaaacaaaaagatactggttgcattgtaactcatgcaacatccttttttttagaaaagaaaaacacagatttggccttcgcacattttttgcaaagaacagaaggtatttttttctgtagtgtgatcacaatgaaaactttattgtctttt

SEQ ID NO: 190098 - DNA, 453 bp, Homo sapiens
  Payload ID: 17537
  Gene Symbol: TENM4
  Gene Name: teneurin transmembrane protein 4
  ENST ID: ENST00000533525
  CDS Start-End: 1-453
ccaactgcgagacccccagggccacatgcttagaccagtgttcaggccacggaaccttcctcccggacaccgggctttgcagctgtgacccaagctggactggacacgactgttctatcgagatctgtgctgccgactgtggtggccatggcgtgtgcgtagggggcacctgccgctgcgaggatggctggatgggggcagcctgcgaccagcgggcctgccacccgcgctgtgccgagcatgggacctgccgcgacggcaagtgcgagtgcagccctggctggaatggcgaacactgcaccatcgagggttgccctgggttgtgcaatggcaacggcagatgtaccttagacctgaatggttggcactgcgtctgccagctgggctggagaggagctggctgtgacacttccatggagactgcctgcggtgacagcaaagacaatgatggag

SEQ ID NO: 190099 - DNA, 524 bp, Homo sapiens
  Payload ID: 17537
  Gene Symbol: TENM4
  Gene Name: teneurin transmembrane protein 4
  ENST ID: ENST00000533074
  CDS Start-End: 54-524
gatgctgaagctgctggtccctggccacactttaaaaaccacgtcctaaaagcatgaaacaatgtgaagttgctgagatggatcatccgggcggcctgcagaaccacgcgcggctccggacgccgccgccgccgctctcgcacgcccacacccccaaccagcaccacgcggcctccattaactccctgaaccggggcaacttcacgccgaggagcaaccccagcccggcccccacggaccactcgctctccggagagccccctgccggcggcgcccaggagcctgcccacgcccaggagaactggctgctcaacagcaacatccccctggagaccagaaacctaggcaagcagccattcctagggacattgcaggacaacctcattgagatggacattctcggcgcctcccgccatgatggggcttacagtgacgggcacttcctcttcaagcctggaggcacctccccgctcttctgcaccacatcaccagggtacccactgacgtccagcacagtgtactct

SEQ ID NO: 190100 - DNA, 170 bp, Homo sapiens
  Payload ID: 17537
  Gene Symbol: TENM4
  Gene Name: teneurin transmembrane protein 4
  ENST ID: ENST00000527736
  CDS Start-End: 31-33
aaaagatcccgcaccatcctccaggatccaatggccttggagagagggctgcagggcccacggacattgctgactcttcagaacgtgctgacatggagccagaccactcggccctgagtgcggcgaggaccctgtttgtggatgtggaggagcgcgggccggaggccatg

SEQ ID NO: 190101 - DNA, 13350 bp, Homo sapiens
  Payload ID: 17537
  Gene Symbol: TENM4
  Gene Name: teneurin transmembrane protein 4
  Uniprot ID: Q6N022
  ENST ID: ENST00000612046
  CDS Start-End: 267-8576
agaaaagatcccgcaccatcctccaggatccaatggccttggagagagggctgcagggcccacggacattgctgactcttcagaacgtgctgacatggagccaggtagactgaaattaccatgtgtccaaattaaaattgcatacttcaaggattatttgaaggactattcttagacccttttaagaagatttaaagaaaaaccactcggccctgagtgcggcgaggaccctgtttgtggatgtggaggagcgcgggccggaggccatggacgtgaaggagaggaagccttaccgctcgctgacccggcgccgcgacgccgagcgccgctacaccagctcgtccgcggacagcgaggagggcaaagccccgcagaaatcgtacagctccagcgagaccctgaaggcctacgaccaggacgcccgcctagcctatggcagccgcgtcaaggacattgtgccgcaggaggccgaggaattctgccgcacaggtgccaacttcaccctgcgggagctggggctggaagaagtaacgccccctcacgggaccctgtaccggacagacattggcctcccccactgcggctactccatgggggctggctctgatgccgacatggaggctgacacggtgctgtcccctgagcaccccgtgcgtctgtggggccggagcacacggtcagggcgcagctcctgcctgtccagccgggccaattccaatctcacactcaccgacaccgagcatgaaaacactgagactgatcatccgggcggcctgcagaaccacgcgcggctccggacgccgccgccgccgctctcgcacgcccacacccccaaccagcaccacgcggcctccattaactccctgaaccggggcaacttcacgccgaggagcaaccccagcccggcccccacggaccactcgctctccggagagccccctgccggcggcgcccaggagcctgcccacgcccaggagaactggctgctcaacagcaacatccccctggagaccagaaacctaggcaagcagccattcctagggacattgcaggacaacctcattgagatggacattctcggcgcctcccgccatgatggggcttacagtgacgggcacttcctcttcaagcctggaggcacctccccgctcttctgcaccacatcaccagggtacccactgacgtccagcacagtgtactctcctccgccccgacccctgccccgcagcaccttcgcccggccggcctttaacctcaagaagccctccaagtactgtaactggaagtgcgcagccctgagcgccatcgtcatctcagccactctggtcatcctgctggcatactttgtggccatgcacctgtttggcctaaactggcacctgcagccgatggaggggcagatgtatgagatcacggaggacacagccagcagttggcctgtgccaaccgacgtctccctatacccctcagggggcactggcttagagacccctgacaggaaaggcaaaggaaccacagaaggaaagcccagtagtttctttccagaggacagtttcatagattctggagaaattgatgtgggaaggcgagcttcccagaagattcctcctggcactttctggagatctcaagtgttcatagaccatcctgtgcatctgaaattcaatgtgtctctgggaaaggcagccctggttggcatttatggcagaaaaggcctccctccttcacatacacagtttgactttgtggagctgctggatggcaggaggctcctaacccaggaggcgcggagcctagaggggaccccgcgccagtctcggggaactgtgcccccctccagccatgagacaggcttcatccagtatttggattcaggaatctggcacttggctttttacaatgacggaaaggagtcagaagtggtttcctttctcaccactgccattgagtcggtggataactgccccagcaactgctatggcaatggtgactgcatctctgggacctgccactgcttcctgggtttcctgggccccgactgtggcagagcctcctgccccgtgctctgtagcggaaatggccaatacatgaaaggcagatgcttgtgccacagtggctggaaaggcgctgagtgcgatgtgcccaccaaccagtgtatcgatgtggcctgcagcaaccatggcacctgcatcacgggcacctgcatctgcaaccctggctacaagggcgagagctgtgaggaagtggactgcatggaccccacatgttcaggccggggtgtctgcgtgagaggcgaatgccactgctctgtgggatggggaggcaccaactgcgagacccccagggccacatgcttagaccagtgttcaggccacggaaccttcctcccggacaccgggctttgcagctgtgacccaagctggactggacacgactgttctatcgagatctgtgctgccgactgtggtggccatggcgtgtgcgtagggggcacctgccgctgcgaggatggctggatgggggcagcctgcgaccagcgggcctgccacccgcgctgtgccgagcatgggacctgccgcgacggcaagtgcgagtgcagccctggctggaatggcgaacactgcaccatcgctcactatctggatagggtagttaaagagggttgccctgggttgtgcaatggcaacggcagatgtaccttagacctgaatggttggcactgcgtctgccagctgggctggagaggagctggctgtgacacttccatggagactgcctgcggtgacagcaaagacaatgatggagatggcctggtggactgcatggaccctgactgctgcctccagcccctgtgccatatcaacccgctgtgccttggctcccctaaccctctggacatcatccaggagacacaggtccctgtgtcacagcagaacctacactccttctatgaccgcatcaagttcctcgtgggcagggacagcacgcacataatccccggggagaacccctttgatggagggcatgcttgtgttattcgtggccaagtgatgacatcagatggaacccccctggttggtgtgaacatcagttttgtcaataaccctctctttggatatacaatcagcaggcaagatggcagctttgacttggtgacaaatggcggcatctccatcatcctgcggttcgagcgggcacctttcatcacacaggagcacaccctgtggctgccatgggatcgcttctttgtcatggaaaccatcatcatgagacatgaggagaatgagattcccagctgtgacctgagcaattttgcccgccccaacccagtcgtctctccatccccactgacgtccttcgccagctcctgtgcagagaaaggccccattgtgccggaaattcaggctttgcaggaggaaatctctatctctggctgcaagatgaggctgagctacctgagcagccggacccctggctacaaatctgtcctgaggatcagcctcacccacccgaccatccccttcaacctcatgaaggtgcacctcatggtagcggtggagggccgcctcttcaggaagtggttcgctgcagccccagacctgtcctattatttcatttgggacaagacagacgtctacaaccagaaggtgtttgggctttcagaagcctttgtttccgtgggttatgaatatgaatcctgcccagatctaatcctgtgggaaaaaagaacaacagtgctgcagggctatgaaattgacgcgtccaagcttggaggatggagcctagacaaacatcatgccctcaacattcaaagtggcatcctgcacaaagggaatggggagaaccagtttgtgtctcagcagcctcctgtcattgggagcatcatgggcaatgggcgccggagaagcatctcctgccccagctgcaacggccttgctgacggcaacaagctcctggccccagtggccctcacctgtggctctgacgggagcctctatgtgggtgatttcaactacattagaaggatcttcccctctggaaatgtcaccaacatcctagagctgagaaataaagatttcagacatagtcacagtccagcacacaaatactacctggccacagaccccatgagtggggccgtcttcctttctgacagcaacagccggcgggtctttaaaatcaagtccactgtggtggtgaaggaccttgtcaagaactctgaggtggttgcggggacaggtgaccagtgcctcccctttgatgacactcgctgcggggatggtgggaaggccacagaagccacactcaccaatcccaggggcattacagtggacaagtttgggctgatctacttcgtggatggcaccatgatcagacgcatcgatcagaatgggatcatctccaccctgctcggctctaatgatctcacatcagcccggccactcagctgtgattctgtcatggatatttcccaggttcacctggagtggcccacagacttagccatcaacccaatggacaactcactttatgtcctcgacaacaatgtggtcctgcaaatctctgaaaaccaccaggtgcgcattgtcgccgggaggcccatgcactgccaggtccctggcattgaccacttcctgctaagcaaggtggccatccacgcaaccctggagtcagccaccgctttggctgtttcacacaatggggtcctgtatattgctgagactgatgagaaaaagatcaaccgcatcaggcaggtcaccactagtggagagatctcactcgttgctggggcccccagtggctgtgactgtaaaaatgatgccaactgtgattgtttttctggagacgatggttatgccaaggatgcaaagttaaataccccatcttccttggctgtgtgtgctgatggggagctctacgtggccgaccttgggaacatccgaattcggtttatccggaagaacaagcctttcctcaacacccagaacatgtatgagctgtcttcaccaattgaccaggagctctatctgtttgataccaccggcaagcacctgtacacccaaagcctgcccacaggagactacctgtacaacttcacctacactggggacggcgacatcacactcatcacagacaacaatggcaacatggtaaatgtccgccgagactctactgggatgcccctctggctggtggtcccagatggccaggtgtactgggtgaccatgggcaccaacagtgcactcaagagtgtgaccacacaaggacacgagttggccatgatgacataccatggcaattccggccttctggcaaccaaaagcaatgaaaacggatggacaacattttatgagtacgacagctttggccgcctgacaaatgtgaccttccctactggccaggtgagcagtttccgaagtgatacagacagttcagtgcatgtccaggtagagacctccagcaaggatgatgtcaccataaccaccaacctgtctgcctcaggcgccttctacacactgctgcaagaccaagtccggaacagctactacatcggggccgatggctccttgcggctgctgctggccaacggcatggaggtggcgctgcagactgagccccacttgctggctggcaccgtcaaccccaccgtgggcaagaggaatgtcacgctgcccatcgacaacggcctcaacctggtggagtggcgccagcgcaaagagcaggctcggggccaggtcactgtctttgggcgccggctgcgggttcacaaccgaaatctcctatctctggactttgatcgcgtaacacgcacagagaagatctatgatgaccaccgcaagttcacccttcggattctgtacgaccaggcggggcggcccagcctctggtcacccagcagcaggctgaatggtgtcaacgtgacatactcccctgggggttacattgctggcatccagaggggcatcatgtctgaaagaatggaatacgaccaggcgggccgcatcacatccaggatcttcgctgatgggaagacatggagctacacatacttagagaagtccatggtgctgctactacacagccagaggcagtatatctttgagttcgacaagaatgaccgcctctcttctgtgacgatgcccaacgtggcgcggcagacactagagaccatccgctcagtgggctactacagaaacatctatcagccccctgagggcaatgcctcagtcatacaggacttcactgaggatgggcacctccttcacaccttctacctgggcactggccgcagggtgatatacaagtatggcaaactgtcaaagctggcagagacgctctatgacaccaccaaggtcagtttcacctatgacgagacggcaggcatgctgaagaccatcaacctacagaatgagggcttcacctgcaccatccgctaccgtcagattgggcccctgattgaccgacagatcttccgcttcactgaggaaggcatggtcaacgcccgttttgactacaactatgacaacagcttccgggtgaccagcatgcaggctgtgatcaacgagaccccactgcccattgatctctatcgctatgatgatgtgtcaggcaagacagagcagtttgggaagtttggtgtcatttactatgacattaaccagatcatcaccacagctgtcatgacccacaccaagcattttgatgcatatggcaggatgaaggaagtgcagtatgagatcttccgctcgctcatgtactggatgaccgtccagtatgataacatggggcgagtagtgaagaaggagctgaaggtaggaccctacgccaataccactcgctactcctatgagtatgatgctgacggccagctgcagacagtctccatcaatgacaagccactctggcgctacagctacgacctcaatgggaacctgcacttactgagccctgggaacagtgcacggctcacaccactacggtatgacatccgcgaccgcatcactcggctgggtgacgtgcaatacaagatggatgaggatggcttcctgaggcagcggggcggtgatatctttgagtacaactcagctggcctgctcatcaaggcctacaaccgggctggcagctggagtgtcaggtaccgctacgatggcctggggcggcgcgtgtccagcaagagcagccacagccaccacctgcagttcttctatgcagacctgaccaaccccaccaaggtcacccacctgtacaaccactccagctctgagatcacctccctctactacgacttgcaaggacacctctttgccatggagctgagcagtggtgatgagttttacatagcttgtgacaacatcgggacccctcttgctgtctttagtggaacaggtttgatgatcaagcaaatcctgtacacagcctatggggagatctacatggataccaaccccaactttcagatcatcataggctaccatggtggcctctatgatccactcaccaagcttgtccacatgggccggcgagattatgatgtgctggccggacgctggactagcccagaccacgagctgtggaagcaccttagtagcagcaacgtcatgccttttaatctctatatgttcaaaaacaacaaccccatcagcaactcccaggacatcaagtgcttcatgacagatgttaacagctggctgctcacctttggattccagctacacaacgtgatccctggttatcccaaaccagacatggatgccatggaaccctcctacgagctcatccacacacagatgaaaacgcaggagtgggacaacagcaagtctatcctcggggtacagtgtgaagtacagaagcagctcaaggcctttgtcaccttagaacggtttgaccagctctatggctccacaatcaccagctgccagcaggctccaaagaccaagaagtttgcatccagcggctcagtctttggcaagggggtcaagtttgccttgaaggatggccgagtgaccacagacatcatcagtgtggccaatgaggatgggcgaagggttgctgccatcttgaaccatgcccactacctagagaacctgcacttcaccattgatggggtggatacccattactttgtgaaaccaggaccttcagaaggtgacctggccatcctgggcctcagtggggggcggcgaaccctggagaatggggtcaacgtcactgtgtcccagatcaacacagtacttaatggcaggactagacgctacacagacatccagctccagtacggggcactgtgcttgaacacacgctacgggacaacgttggatgaggagaaggcacgggtcctggagctggcccggcagagagccgtgcgccaagcgtgggcccgcgagcagcagagactgcgggaaggggaggaaggcctgcgggcctggacagagggggagaagcagcaggtgctgagcacagggcgggtgcaaggctacgacggctttttcgtgatctctgtcgagcagtacccagaactgtcagacagcgccaacaacatccacttcatgagacagagcgagatgggccggaggtgacagagaggaccaaggacttcttgccaaagacagctactcttttgtggccgcatacctgactgtgttgtacttttaaaaaaatgattttttaacaagtgcagaaacaaaaagatactggttgcattgtaactcatgcaacatccttttttttagaaaagaaaaacacagatttggccttcgcacattttttgcaaagaacagaaggtatttttttctgtagtgtgatcacaatgaaaactttattgtcttttgttccctttttccttgaggatttttcccttgtcgtttggggtatgtatctcctctctgagatgcatctcctggggtgtgtcctcgtctgtccctaggtacccagtgtgatgtgggacatgaatgtctgtgctaacttgtctcatgtgcaaccctttcttcttcgactggggtcgggcaggagtaaagggagtgatgggccagtacaacaccccttccaagggggcctgggaggagggtctgtaggacctgaggctccttggcagggctcctgcagaagagtggtggatttcttctcaccttgttctctgcctccagaggatcatagatggcttcatcttgctccagggaatttcatggtgttgttcagcaccttttttaagctgccccaaactcctgttcaagctttctattttgatgctgaatgaaaccccctaccacttttgcaaatcctgtgtagttgtcggtgccacccccatgctgggatagagaaagtgtctcccaggtcctttcccccagaccagtgacataacatcctgggctcagagtcccatcctcccgggagggaaagcacccaggatgcctgtgattggttggtcctccatgatgttcctgttcatctcctcctttctcccaaagccagatgtgagaacgagcactgcacagcaagccttcaatgtgggcaccatgtccacagaacagaaggccacccatggcaaaggcatggcagtggtggcgagggcaccagcctgccttccgaggcaaagccctctctctatgactttgagtatcttccctccaccactcagccgccaccactgagacgtaggaatgtggagggaggtgcttggtggcctttgattctggaaaaatgcttaacaaaaaaagccagccaaagagaggaaggcataagctaagcatccttctaaccagttcccaaagtcccatctgcctccatgtaccagctgatcgcagagctggactggggcaggctgggcttccaggaaattcctgaagttctgaaacagcttcccctctagagaagcccacccaatgtgttttttagtgacaggaagaaaggagggaagagctgatgtggtgtggcctgcccatatcatacaaccccaccaggagcagggcagttcccaaggtgggtgcccgtagatctgggaggccaggctggcatgattcctgtgaagaactgtgcctgtgtcgtcagggagaggcctgagccctctcagaagcagggacagcccacacctgaagagcacgcccaagctgaggcagcagccagcaggctgggggagcagtgagggcagggggagtcacagccagagctgggagccccttgttcaaggattccattcctggttcatccgcctaattaccattgtcattaccactcacaggaggctctgggagatgggaggggaagccaaatgcttccttttaagctgggcttcttagaaaatggaacttttatgggttacatttacattaagtgtggaaaatgaattctgagtctgagctattccccgtggaaaccttgttggactgataagctcatggcacctctatagccttactcacatagtcttcagaatattacacaagttaatgaaactgagaaggtctgactgcatgaggatcggagcagcatgtagtctgggttctgcctggcagagggaggcaaccaaaacttcttggggagaggagatttcgccttaacgtcatcccactgggattagaggatgtgtttcgctaagtgctcttcctgtttccaaaaaaaaagccaccctgctgcagcagtgcgctttggcctgcttgtccactggttgcccattgcccctggatccagagctctactgagtcagatacagtgctctgcaggcctgctgtgggaggcatgagctggagatgggggctcccatctggcaggatcattcttggatgagatggaaaacagtttggcctgaagaacacaagttttgtcctccagaagggacttacgcctctcaaaatgtactcttcataccaagggcccttgggcaaagtgctcctgcccagttgatcagtcccatcctggctgcctgacatcagtgaagacctgctggggatgtctgctcagaggtcaggaacggcatgcggtccacaggaaccagctccctacgcttcccccacgccctgtccctcctccacagccccctccccaaaggaatagggtggacttttagggatcaaaaacagaattattgggtgtttcatttatttttttctttctttcttttttttttcatagagatggggtctcactatgttgcccaggctgttctcaaactcctggcctcaggcgatccaccttggcctcctgaagtgctggggttacaggtgtgagccactgcgcctggactgagtgtttgtttctttaaaggatcttatatttttcctgtgctacataccaccacagcagcccagcttctgtggggagagaagttgaaggatcccgaagctttagaaaaaggatctcagctgtggcacaggcagtgttatgcgcctcactgccacattggtgctgttgtattgaaggtggtgcttctggccttggcccttttgagttggtttccatttgggctgcaggtgactcagtgactccctcctcaagctgtcctcctgctaagaccagcagtcacaaacccatggcaagggtgagtgtgaaggcctaaccctgtgcctatgtaataggctccaagcatcgactcccatcctgagaggaccggcccttttgacactcaccaaccaaatctgttcattcgatagagtgaccaggcctccctcacctgcccaggtgtatgatcctacagttcctgccttctctcctaccccgcacagctgccaactggtcctacatcctcagcccctctgccaccaccttaaataggactttactgattccccaactttgtttttttgtaggatgagatttcctttttatcccacccccccacaccccaaacagacattgctggagggcagactggaggaaggggaaggcatgcaggtaaattactgccttgtcagcctctgaccctcatctctcagaattgttggctgagaattaacccaaggaccacaccagtgcctgatttctacttagggagagaggattggaaacgatccctaagaaactgactgagggtgagaatggccaggaggtgtgtgtccaaataaccaggagggggcacagaagatgatggcaaggcagactgggcagtgttttgtagacacagaacaaagaatcagaatttgaaaaaagaagaaaaacaaatcttcgcagctgcaactttaaagtatcacctttatagatggcagggatttccattatgcaaatggaatctaagatttcaatgtgaaatcttagaatgcagttttaccacttgcagtcttgtatttgtggtggccatgtggtgagggcggtgatgctgagctttctgcccaggaggaatgagctttcaagctctcagcagggtgtcaggcttggggatttgagcatccactgctcaaagtccaggctattctccagtcctcacggcagccactaagcccaggagccagacctggcccggggacacatctcctgagggatcccagaaagaacccagtctttcctttcccttggggtccttgttagaatgaaaacctctctatttaaggcacatcattcccagctaggtttatacacttgtctatattttactggaggaaagggaattaaaaaagaactctgcagttcaaggccctttcatttaaccttccaaaaacagcaaactcattttaaagactcattgctgaggtgatagagagaaaccttatcctctccaaccttcacattcacaaaaaccatccttgtgtacttgactgccctagacagtggtgactcttaggtttcattacgaatgtggaatatcagagtgtgggaaggcccaggcgagggccaatgttgtgtttcttaccccctctggaatgccaaaggcaaggtactaggtgacctcctggtccccaagaaaatgtgatttattctgagggcgaacagccaagggaggactagtctggagcacgctcggccgtcctggcaggagctgagcctcaggtgtctggcggtgccccagcagccctggattcacccaacaccagaatcccacttttctaaatccacctgttgttctgagcacctctgaacccgcagcttcggcaaaaggagtctgtaccaagctgcttctggatgaccaacactggagactctggccttaccatgtggaaatcattttcctgaagtctggaactaattttgagaagtttttttctcaacacttttgtgtttctaacactgtatcttgactgtgtaaataccaacaaggctgtaaataaatgcagatgtagataccttctagaaaaaaaaaagcataaaaacaaaaccagaagtgatcccgtgtagccttcgttgacaaataaagactattttgtgttt

SEQ ID NO: 190102 - DNA, 1339 bp, Homo sapiens
  Payload ID: 17538
  Gene Symbol: TNMD
  Gene Name: tenomodulin
  Uniprot ID: Q9H2S6
  ENST ID: ENST00000373031
  CDS Start-End: 218-1171
tgtgcacagaagttatatacatatatgggtatatctatgtaacaaatcgcagcacaggagtcccctgggctccctcaggctctggtatgacatatttgagccatataaattcagcttctcctctggcatctgttagccgactcacttgcaactccacctcagcagtggtctctcagtcctctcaaagcaaggaaagagtactgtgtgctgagagaccatggcaaagaatcctccagagaattgtgaagactgtcacattctaaatgcagaagcttttaaatccaagaaaatatgtaaatcacttaagatttgtggactggtgtttggtatcctggccctaactctaattgtcctgttttgggggagcaagcacttctggccggaggtacccaaaaaagcctatgacatggagcacactttctacagcaatggagagaagaagaagatttacatggaaattgatcctgtgaccagaactgaaatattcagaagcggaaatggcactgatgaaacattggaagtgcacgactttaaaaacggatacactggcatctacttcgtgggtcttcaaaaatgttttatcaaaactcagattaaagtgattcctgaattttctgaaccagaagaggaaatagatgagaatgaagaaattaccacaactttctttgaacagtcagtgatttgggtcccagcagaaaagcctattgaaaaccgagattttcttaaaaattccaaaattctggagatttgtgataacgtgaccatgtattggatcaatcccactctaatatcagtttctgagttacaagactttgaggaggagggagaagatcttcactttcctgccaacgaaaaaaaagggattgaacaaaatgaacagtgggtggtccctcaagtgaaagtagagaagacccgtcacgccagacaagcaagtgaggaagaacttccaataaatgactatactgaaaatggaatagaatttgatcccatgctggatgagagaggttattgttgtatttactgccgtcgaggcaaccgctattgccgccgcgtctgtgaacctttactaggctactacccatatccatactgctaccaaggaggacgagtcatctgtcgtgtcatcatgccttgtaactggtgggtggcccgcatgctggggagggtctaataggaggtttgagctcaaatgcttaaactgctggcaacatataataaatgcatgctattcaatgaatttctgcctatgaggcatctggcccctggtagccagctctccagaattacttgtaggtaattcctctcttcatgttctaataaacttctacattatcaccaa

SEQ ID NO: 190103 - DNA, 10331 bp, Homo sapiens
  Payload ID: 17539
  Gene Symbol: TNS1
  Gene Name: tensin 1
  Uniprot ID: Q9HBL0
  ENST ID: ENST00000171887
  CDS Start-End: 454-5661
gttggcccgccccctgggctggcctgggagggaacccgactagcagagccctctgctcagttgctcccagcagtggccctgggaccagctctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcacctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaaagaaaactctg

SEQ ID NO: 190104 - DNA, 1792 bp, Homo sapiens
  Payload ID: 17539
  Gene Symbol: TNS1
  Gene Name: tensin 1
  Uniprot ID: Q9HBL0
  ENST ID: ENST00000310858
  CDS Start-End: 173-1423
gagccacccagtagtgtctgagtggtgatccactcttgcctgcaatgaggaccaaggcaaaaagagttggctgaatctgcagcaggaaggatgagggttagataccaggaggaaattcctgacagtgagaaaagtaagacactctgtctgggaggctgtcgaatttcctttcatggtgccctttcagcaaaggaaggattgtgttttggagggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggatgggaacaaacagaataccaatagccagtcaattggaagcatctcaggtggcctggaggatcaatatacctggccagacacacactggccttcccaaagttaggccctccaaaatgtcaagttgccaagccagaatccaaagctttgcactgagaacttcatgttggggctcctgtcccctcctggagccctgcctgggtgacaccccagtccttctattcaggtcctgtgttcacctctgggaagtgcaggaccctgtggggttttttctttttccttttccaagccaaggaagtgttctggctcctggactctgccctgtggaggggaaagggggagagagagggaaaaaaagatttccaccttattgttcagcagctggaaaattgttgtcatctgttctgccttccatttgctgagaatggaaaaaaaatgtggaaaatttggggaaataaatctcaataccctcata

SEQ ID NO: 190105 - DNA, 582 bp, Homo sapiens
  Payload ID: 17539
  Gene Symbol: TNS1
  Gene Name: tensin 1
  ENST ID: ENST00000449814
  CDS Start-End: 510-582
agttgctcccagcagtggccctgggaccagctctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacgcactgcggagccaggagaggggtgcaggggctcctcttcttggagaccccgtggtcaagccccaggttggagtgtgaatcctgcctggccgtcaacttcccagggacttgaggggctccaccagggtcaccccgagtgtccagccccacctccagcccatcagaaacatgagtgtgagccggaccatggaggacagctgtgagctggacctggtgtacgtcacagagaggatcatcgctg

SEQ ID NO: 190106 - DNA, 4292 bp, Homo sapiens
  Payload ID: 17539
  Gene Symbol: TNS1
  Gene Name: tensin 1
  ENST ID: ENST00000446688
  CDS Start-End: 82-2622
agaggtcccaaggatggagtcctggaacctcccacattccaaggctacagacaggaggagggaaccagcataggaactggcatggagcagcttgtgaaggagaggaaaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggtt

SEQ ID NO: 190107 - DNA, 667 bp, Homo sapiens
  Payload ID: 17539
  Gene Symbol: TNS1
  Gene Name: tensin 1
  ENST ID: ENST00000413280
  CDS Start-End: 360-667
cttccctccgtccctccttccctccttccttcccgagcgcggattgcgggctggggtgggaggagatttcgcggagtttccatttcatacctcgcggctaaaactttctttctgtgtctcgccctcttgcagtctgcagcttctcctgtcatcggaaatgccaggccaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgc

SEQ ID NO: 190108 - DNA, 1478 bp, Homo sapiens
  Payload ID: 17539
  Gene Symbol: TNS1
  Gene Name: tensin 1
  ENST ID: ENST00000413554
  CDS Start-End: 17-1478
aggcagcctgactcccatggtgagcccactgccaccaccacattgccctggggcagccctgcatgtccagccctacaaagcggcagcatcccatggaccgcatggggcctctccaggtggagcagggagcatgcctcttaaattagtggggaaggttctgctcaagggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacg

SEQ ID NO: 190109 - DNA, 538 bp, Homo sapiens
  Payload ID: 17539
  Gene Symbol: TNS1
  Gene Name: tensin 1
  ENST ID: ENST00000439083
  CDS Start-End: 355-538
agtagccccacttggctcttccctccttcactgctgaggagctgctcattggtccgaggcagctgggactctgggcagagccttcttccggacagctggatggagggtccccctcttagcagagctgctctaacttggggctcagctgggagctggacctcggaacccacctatcctgcctcgtaggcactgcggagccaggagaggggtgcaggggctcctcttcttggagaccccgtggtcaagccccaggttggagtgtgaatcctgcctggccgtcaacttcccagggacttgaggggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctg

SEQ ID NO: 190110 - DNA, 2464 bp, Homo sapiens
  Payload ID: 17539
  Gene Symbol: TNS1
  Gene Name: tensin 1
  ENST ID: ENST00000446903
  CDS Start-End: 124-2464
agatgctggcggagccggagcagccgcggactcagagagcccttctgccagcgccgcggggactctagcttcaggggctcttcacaggccctgggcgtgcctcagtgacgggacccagcaaagatgacgtggatctgtctgtcctgcatgctctggccagaggatctggaggcccccaagacacaccgcttcaaggtgaagaccttcaagaaggtgaagccctgtgggatctgccgccaggtcatcacccaggaaggctgcacctgcaaagtctgcagcttctcctgtcatcggaaatgccaggccaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagc

SEQ ID NO: 190111 - DNA, 5900 bp, Homo sapiens
  Payload ID: 17539
  Gene Symbol: TNS1
  Gene Name: tensin 1
  ENST ID: ENST00000430930
  CDS Start-End: 163-5307
aaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcaccc

SEQ ID NO: 190112 - DNA, 5921 bp, Homo sapiens
  Payload ID: 17539
  Gene Symbol: TNS1
  Gene Name: tensin 1
  ENST ID: ENST00000419504
  CDS Start-End: 163-5328
aaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcaccc

SEQ ID NO: 190113 - DNA, 548 bp, Homo sapiens
  Payload ID: 17539
  Gene Symbol: TNS1
  Gene Name: tensin 1
  ENST ID: ENST00000423413
  CDS Start-End: 183-548
gcaaaacgcagtgggaatgtcaagcaggaggcagctcatgtgagctggcagagcggaggaagctttggagaagaggtaccatttgagatggattttgaagtttggcaaggagttttgcggggaggaaaaggggcaaagacttcttcaggcacaggggaaggcatgtgcagaggcccagtggcatgcaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctggtg

SEQ ID NO: 190114 - DNA, 601 bp, Homo sapiens
  Payload ID: 17539
  Gene Symbol: TNS1
  Gene Name: tensin 1
  ENST ID: ENST00000453356
  CDS Start-End: 1-448
aggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggagggggcccagcaccctcagattggccaagacaccccaccaggcccctccgaccccccaggctgcttgtgaaaagcactcctccatccccgggcgctgagcggccaagcagaaagcagaggctggagcgaatttgttctgaggtttcagtggctgccagcctaattggtcgttgtgctggggatgtttgcatttttaacaagaacatttggcaattggaaagaa

SEQ ID NO: 190115 - DNA, 6488 bp, Homo sapiens
  Payload ID: 17539
  Gene Symbol: TNS1
  Gene Name: tensin 1
  ENST ID: ENST00000615025
  CDS Start-End: 1378-5475
aggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaagg

SEQ ID NO: 190116 - DNA, 6509 bp, Homo sapiens
  Payload ID: 17539
  Gene Symbol: TNS1
  Gene Name: tensin 1
  ENST ID: ENST00000611415
  CDS Start-End: 331-5496
aggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaagg

SEQ ID NO: 190117 - DNA, 5010 bp, Homo sapiens
  Payload ID: 17540
  Gene Symbol: TNS2
  Gene Name: tensin 2
  Uniprot ID: Q63HR2
  ENST ID: ENST00000314250
  CDS Start-End: 291-4520
gggggagcaaaagatcacaggctgacactcccagcagggtagatcctgggaatctgatctcctggcctcccccacatcctcccccctccacttcctggagcagcgacctgcccccttcccgcctgcacttccctccacttccagggccgggcttctcctcacaccagccagacagcctaccctccgcccaggggaagcggctgcctccgccaggccgcttccaggaagccccgggccaggccccagcattgttcaggccctggggccagcaccccagccagccgaacaccatgaagtccagcggccctgtggagaggctgctcagagccctggggaggagggacagcagccgggccgcaagcaggcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaacttta

SEQ ID NO: 190118 - DNA, 4944 bp, Homo sapiens
  Payload ID: 17540
  Gene Symbol: TNS2
  Gene Name: tensin 2
  Uniprot ID: Q63HR2
  ENST ID: ENST00000314276
  CDS Start-End: 196-4455
gcacattctttcaagtgacagctatagcctgtcccaggggctgctgtccacagcttggggctgaagactcccaggccattaaccccttagcttttaggaagattactccccctttttcaaggccccatccacctccctcccttgactcccaggacgggaagttggccatgttcccaggagggaggccggaggcccatggatgggggtggagtatgtgttgggaggggggacctcctgtccagtcctcaggccctgggacagctgctgaggaaggagagcagacccaggagagccatgaagcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaacttt

SEQ ID NO: 190119 - DNA, 4737 bp, Homo sapiens
  Payload ID: 17540
  Gene Symbol: TNS2
  Gene Name: tensin 2
  Uniprot ID: Q63HR2
  ENST ID: ENST00000379902
  CDS Start-End: 393-4250
caactctctccccctctcagccacttcctgtctccagtatgtccctggcgcggcccggctggccgtctgcgcaccctctctcccctcggctctttcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaact

SEQ ID NO: 190120 - DNA, 4714 bp, Homo sapiens
  Payload ID: 17540
  Gene Symbol: TNS2
  Gene Name: tensin 2
  Uniprot ID: Q63HR2
  ENST ID: ENST00000552570
  CDS Start-End: 1-4224
atgaagtccagcggccctgtggagaggctgctcagagccctggggaggagggacagcagccgggccgcaagcaggcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcaggcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaacttta

SEQ ID NO: 190121 - DNA, 678 bp, Homo sapiens
  Payload ID: 17540
  Gene Symbol: TNS2
  Gene Name: tensin 2
  ENST ID: ENST00000546772
  CDS Start-End: 1-103
ggaaagcacccggcgacaggacaccaggtcccccacctcagcgcccactcagagactgagtcctggcgaggccttgccccctgtttcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctgg

SEQ ID NO: 190122 - DNA, 4525 bp, Homo sapiens
  Payload ID: 17540
  Gene Symbol: TNS2
  Gene Name: tensin 2
  ENST ID: ENST00000549700
  CDS Start-End: 1-4035
atgaagtccagcggccctgtggagaggctgctcagagccctggggaggagggacagcagccgggccgcaagcaggcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaacttta

SEQ ID NO: 190123 - DNA, 4429 bp, Homo sapiens
  Payload ID: 17540
  Gene Symbol: TNS2
  Gene Name: tensin 2
  Uniprot ID: Q63HR2
  ENST ID: ENST00000546602
  CDS Start-End: 1-3939
atgaagtccagcggccctgtggagaggctgctcagagccctggggaggagggacagcagccgggccgcaagcaggcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattcccagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaacttta

SEQ ID NO: 190124 - DNA, 590 bp, Homo sapiens
  Payload ID: 17540
  Gene Symbol: TNS2
  Gene Name: tensin 2
  ENST ID: ENST00000602335
  CDS Start-End: 1-590
cagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggtgcgcaggcagcctgcagggtgggaggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgc

SEQ ID NO: 190125 - DNA, 7618 bp, Homo sapiens
  Payload ID: 17541
  Gene Symbol: TNS3
  Gene Name: tensin 3
  Uniprot ID: Q68CZ2
  ENST ID: ENST00000311160
  CDS Start-End: 359-4696
agccagccaggaggacgggcccgcccgcgcgctactcggagcccagcctcgttgcggccatcgccctgccggaccgcgcctcaggctcccccagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagcggcctcacctctgccagatagtccaggtgataaacttgtgatcgtgaaatttgttcaagacacttccaagttctggtacaaggcggatatttcaagagaacaagccatcgccatgttgaaggacaaggagccgggctcattcattgttcgagacagccattccttccgaggggcctatggcctggccatgaaggtggccacgcccccaccttcagtcctgcagctgaacaagaaagctggagatttggccaatgaactcgtccggcactttttgatcgagtgtaccccgaagggagtgcggttgaaagggtgctcgaatgaaccatatttcgggagcctgacggccttggtgtgccagcattccatcacgcccttggccttgccgtgcaagctgcttatcccagagagagatccattggaggaaatagcagaaagttctccccagacggcagccaattcagcagctgagctgttgaagcagggggcagcctgcaatgtgtggtacttgaactctgtggagatggagtccctcaccggccaccaggcgatccagaaggccctgagcatcaccctggtccaggagcctccacctgtgtccacagttgtgcacttcaaggtgtcagcccagggcatcaccctgacagacaatcagaggaagctcttcttccggaggcattaccccgtgaacagtgtgattttctgtgccttggacccacaagacaggaagtggatcaaagatggcccttcctcaaaagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttggagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaa

SEQ ID NO: 190126 - DNA, 5070 bp, Homo sapiens
  Payload ID: 17541
  Gene Symbol: TNS3
  Gene Name: tensin 3
  ENST ID: ENST00000428457
  CDS Start-End: 1-64
gattttctgtgccttggacccacaagacaggaagtggatcaaagatggcccttcctcaaagtaagttgctgagatttctttacattctctccttgtctgcagttgtactccaaagttgaattctcttccagatttgcacagggggtgccttataagaaaatgactacaccatgccaatttcttttaaaaaagaaaaaagtaaaagtgttctcattatggacaaggatctggatgctgttaacttttctgccggctgttggctggatgtgcaatatttacatgtgtcatataacactgtggcatagatacagggagatggatggcacagcctttttggccatttgggaatgcatgggctcagcagtgctgaggtctgcacagctagaaggaattgctccctttgtgcaggtgtgtggatgaagcgggtgttccaaatttaccaaatgcaacggaggagggccttcatcacaccgttgctccacagccagtccaggcagctgttagagtttttttttttttttgagacagagttttgctctttttgcccaggctggagtgcagtggcgcgatcttggctcactgcaacctctgcctcccgggttcaagcaattctcctgcctcagcctcccaaatagctgggattacaggcgtccgccaccaggcccagctaattttttgtatttagtagagacggggtttcaccatgttggtcaggctggtctcgaactcctgacctcaggtgatccacctgcctcagcctcccaaagtgccgggattaaaggtgtgagccaccgtgcccggcttagagttccccttttataagcacacctttccctggctccctgagtaccgtggccttgcttggcctgggctcattcctggcccagtgttcctgtcagggccagctgagggacctcatcctaacctcccacttggaggcacaatgggctgtatccccccagcctggtttcctcggcataacccggatttaatgaccacagtgcctgatcacaggcatccttccctggaatcctgttttcaaatggcttgtctgtccaggaagttgctcagtgcatgcgttagcagaagcggggagaaggagaagagaccctggtactgacgagctgggcttccccggtggggactgtgttctgggcacactcccactctggctggtagcagaaacacgggctttcatgtgcttggaatttgtgactgtattggggttacctgagtgtcattgactggtcccttcatgatgcggaaactgctaaatttaaacaaaaaaaatccttcatttttctaagaaagagaagaaagtcctttgcccaggacctggatagggatatggtcattattgtgtgaagtgcaggactcataaaagcctattaagataatggctctaattcttctaagaaaaataattcgatgggctgttctttttaaacagctccctgaagtctatgtagtttgtaatgcaggcttccaaggcctgagaggagcgcctagtgtatttccccttcggtcccagtgggtgggagtgtcgaagtccagacaggacttgcattctggcatcatctcaggagcccctgagtcccttgccactcgccttgcagactgtggtccagtatgtcaggactggggctcaggaatctgcagggacaggtgcccaggagattctggccctggcgtggggaagcatctatagaggaagttgagcctcagctttgattcaggtcctaacctggggctgtggacagggcactcacctctcagcctcagggtcctcactgcagagctagagtcagacatcccatctgtaggtctgtgaaggctggaggtaaagtgcatgaacaggtggccagcagggtgctgggcacgtggttgatttttgataggtgccacttaaaattcctcctgacagtgccgctggcagctggaggaagtagaagcttggtactttgtgggacactgaccactctgactggactttcctttggcagagtctttggatttgtggcccggaagcagggcagtgccacggataatgtgtgccacctgtttgcagagcatgaccctgagcagcctgccagtgccattgtcaacttcgtatcaaaggtcatgattggttccccaaagaaggtctgagaactcccctccctccctggacccaccgatgcctctcgaagccctggagacagccgttgggtgagggtggggcccccactttttaccaaactagtaaacctgacattccaggcccatgaggggaaagaggatcttccagctctgcaaaaacaagaacaaacaacatcaccgtgaattggcctttcctgaaagtgacttatctgacacatctctgtagccacatgctttttgggtagaagaagctgggcatgggtgcaccccaccccctagggtccccatgggaaagggacatgcaaggaaacagcacagaacacgaggtggtccccatgtccctggcacactagcattccgggggatgaggaatccccagcccttgaggcagaggtgccgagtgactgccatgcttcgcccgtccgcatgggcgcttctgtccagctgcacccgaggccgggggtttccctcacctcggtcttcccaagatggagatgctaacgaaactgagaagggggcgtatgtttgacgaaggtttgtgcaagtcaggcccttctggaacacagcagggcctacaacgaggggcctttgcgatgggctgtgaggatgggggtggtgggaagaattggccacgttggagaccccatgccaccccaccatggtgagtgctctgtgcctcctgctcacctgtggtgagctgggcgagctgggcgagctgggcgagctgggctggggagagcctgtgaggaccgagaggagaaatgagaagaaggaacaaaaatattatttctatgtaatttatattttacttatgccaaattatttatgataatttgccattgctatactgtaccagtgtcaaatgctgcagcctgccaagctgtgattttgtgaggcttgtccctatgtaggatgcaccgcaggcccctggccactgaaagagtgtgcagtggactgtgggtctcccatatgcggtgccgcccaaaggtggctttgcctcaagcaacctaccctgatgttttactcattggaatgtttttccccgattgtggatgacttcttttctgatggagagagtccaggagggatggaaaactcctggatttaagctcagcatcccccacatgggcttttcgatcatcttcaggcctgaagctgcacgacctgaagttcgcctgcatttatcagccctctttgtgctgctccttgccaccttggggttcctgctggggaccatgtgtggttgtggcatgtgtgagcagaagggaggatgaggaaaaagagaagaaaccccggtactgacaagctgtttttgagtgccactgtttgccatcatctaagccactgaatcaagtgtatttcaggcttatttcaacattccaatgccctggttttcctgcttgaatctgttcgtggtcaaaggtttgggggaatttgtgaccctggaacatccccagagtgaaagatggagctgggccacatcagaataaggccttggccccatcctctcacagcctaggtgctctgcaggcatgctgactgtcctgattgcgatccagcccgaaattccctcctctgctttcaaaagtcaaatcccccattcttaggccacactggtgtcacaagctcctgtcagggagctggggtttgggaatgtgctttgtgaactctgctttaaagtgaggggccgaggaaaacttagaaacaggcagagttggaagcagccaaatcacagtgggtgttgtgtgtgtgtgcgtgtgtgcatgcgtgcgtgtatgcgtgtgtgaaagcaggtggaccattccactttttagctcctattgatgcaccaaaccaagtgcctcatttctgtgccaaatgtttgccttggtcgttgtggacctccttctctaacttgcggtggcatgactgtcaggaggtgctggcattttcagcagatcctcatgtgttgaccctgatgtctttagcagaggcctctagcatctcggtttttcatccactgcaggaatgtggccacagggagcagaggtttgtactttccccaagaggtcctcatcctgagacggtctctacccatgtttaacccaaagagtgcaggccaggttccttatccttctgatgaaggatgagagagctcatttagaagtcagagcaaactagggtctcagtattgagaaacgcagcctgccagggaatcacagagacatcggggtgcccgcgatggccctcatgaagccatgcctcgacggcattcaggaagccctgcaaacgtgctttttgaactcattggccaggtgtgatttttacacaaggtaaacgtggtcaagggcatcggggaatttgctccaagcagatagctccctctgaggaaccaaaggaagcaagtttccacgatttctgaagagctggtataggaagtttctttcttccttttgtgttacatgtgcattaaacagaacaagctgtgtgtcatcacagattgtactgtgggctcagaaaccgtgagagagcccccaccgtggacaccggctctagggccacaggaaaaggaacgtttccaggcattttgtctccagggctcccgctggacaggcacgtactgccctggggagtaaatgcggagagttcacgaactgtgcccaacgcatgttatagccagggtcctactaactactcagtaaaagaacgtattgttgtattcctccagtgttaagctatagccatgttaaaagtcactgtgcatttattctcagcatcaaataccttgtaacgtcttctctgccttgttagtgcatatttttacttttctgatactgtaaagaatatatccagtatgtaaatgaatgttctataaatcttttgtatagtcattttctctgctccttaaatatcatctctattcagagtataataaaattatgaacttggtaa

SEQ ID NO: 190127 - DNA, 698 bp, Homo sapiens
  Payload ID: 17541
  Gene Symbol: TNS3
  Gene Name: tensin 3
  ENST ID: ENST00000413551
  CDS Start-End: 375-698
aggctggccctcagccccgggcggacattgtcctgtgagctccatgcctgcgtgctcaccgtggggccgggcacacctgccagctgctcctggctgtggttctggggactcccacactcaccaggctctcccacctggtgggctattccagctgcctcctttatgcccagagctgccgagacattaacacgaagaggggtgtgcttgactaaagcaggggaaggagcgaaacgtaggaggagctgtttctggaagggaaaagcagccctggccggtggtccctgcccaggcccagcacagctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcagg

SEQ ID NO: 190128 - DNA, 1156 bp, Homo sapiens
  Payload ID: 17541
  Gene Symbol: TNS3
  Gene Name: tensin 3
  Uniprot ID: Q68CZ2
  ENST ID: ENST00000458317
  CDS Start-End: 368-1120
agaatgggaaactgccttgggagaagccccaagtgagcccaagggcgcagagcagaaggaccctggagtgtaagagcctagattgcaagcctggcaggaggagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtcatgaattacaatattgcgaacatctgaagtcattttcagctccaagtgaagaaatcatggtta

SEQ ID NO: 190129 - DNA, 1166 bp, Homo sapiens
  Payload ID: 17541
  Gene Symbol: TNS3
  Gene Name: tensin 3
  Uniprot ID: Q68CZ2
  ENST ID: ENST00000442536
  CDS Start-End: 368-1120
agaatgggaaactgccttgggagaagccccaagtgagcccaagggcgcagagcagaaggaccctggagtgtaagagcctagattgcaagcctggcaggaggagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtcatgaattacaatattgcgaacatctgaagtcattttcagctccaagtgaagaaatcatggtgaaatgctacca

SEQ ID NO: 190130 - DNA, 1832 bp, Homo sapiens
  Payload ID: 17541
  Gene Symbol: TNS3
  Gene Name: tensin 3
  ENST ID: ENST00000450444
  CDS Start-End: 201-1832
caataaaaagccaccttcaaccatttgccttccactctggcttgcataggcagtgggctggcctgtgctcctggccgttgttcctgggtggaccccagagagtatgaatcctggtactcaggttggaggagttttatcctgctgggggctatctgttcattgctgaattcagatttctttggccggttcctgtgggcaccatgccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgc

SEQ ID NO: 190131 - DNA, 560 bp, Homo sapiens
  Payload ID: 17541
  Gene Symbol: TNS3
  Gene Name: tensin 3
  ENST ID: ENST00000434451
  CDS Start-End: 219-560
ccactcgagtgggacccgtggcgcccgggcgccctggactgagggcagagaccggagcagctatgtcgcagtcgctgtcgggaccgagcggactttgctccctaggactccgtctcgagactccaggtggagagcgcagctaggggcttcaatgggcaggctcaagacccttctcctactttttctaggacttgtccaaggtggatctgagcctcctcatgtgctccaggcagagatcaggattcggatgcatcaccaactggtggaagatggggactaggcaccctgcacaccctgcacagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagt

SEQ ID NO: 190132 - DNA, 570 bp, Homo sapiens
  Payload ID: 17541
  Gene Symbol: TNS3
  Gene Name: tensin 3
  ENST ID: ENST00000415929
  CDS Start-End: 156-570
ttgtcagtcttgatctgctacagctttgtagccagagtgaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttg

SEQ ID NO: 190133 - DNA, 3836 bp, Homo sapiens
  Payload ID: 17541
  Gene Symbol: TNS3
  Gene Name: tensin 3
  ENST ID: ENST00000457718
  CDS Start-End: 88-3836
cgcgactcccactaggctatgagctacaggagggagggtaggtcttgctcccggagagcaccttaatcacaggcgctgaatgaaagaatgaactggttgtgcaggaaccaggatccgaacccgcctccccagccggaagaattaacctcgagtctgcacgcttttaagaacaaggcctttaaaaaatccaaagtgtgtggagtttgcaaacaaattattgacggtcaaggtatttcatgccgagcctgcaagtattcctgccacaagaaatgtgaagccaaggtggtgattccctgcggtgtgcaagtccgactggaacaggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctacaacgttggcccagaaaaccccagcaggatctgcatcgtcatcgagccggcccagcttctgaagggagatgtcatggtgaaatgctaccacaagaaataccgctcggccacccgtgacgtcattttccgcctgcagtttcacactggggctgtgcagggctacgggctggtgtttgggaaggaggatctggacaatgccagcaaagatgaccgttttcctgactatgggaaggttgaattagtcttctctgccacgcctgagaagattcaagggtccgaacacttgtacaacgaccacggtgtgattgtggactacaacacaacagacccactgatacgctgggactcgtacgagaacctcagtgcagatggagaagtgctacacacgcagggccctgtcgatggcagcctttacgcgaaggtgaggaagaaaagctcctcggatcctggcatcccaggtggcccccaggcaatcccggccaccaacagcccagaccacagtgaccacaccttgtctgtcagcagtgactccggccactctacagcctctgccaggacggataagacggaagagcgcctggccccaggaaccaggaggggcctgagtgcccaggagaaggcagagttggaccagctgctcagtggctttggcctggaagatcctggaagctccctcaaggaaatgactgatgctcgaagcaagtacagtgggacccgccacgtggtgccagcccaggttcacgtgaatggagacgctgctctgaaggatcgggagacagacattctggatgacgagatgccccaccacgacctgcacagtgtggacagccttgggaccctgtcctcctcggaagggcctcagtcggcccacctgggtcccttcacctgccacaagagcagccagaactcactcctatctgacggttttggcagcaacgttggtgaagatccgcagggcaccctcgttccggacctgggccttggcatggacggcccctatgagcgggagcggacttttgggagtcgagagcccaagcagccccagcccctgctgagaaagccctcagtgtccgcccagatgcaggcctatgggcagagcagctactccacacagacctgggtgcgccagcagcagatggttgtagctcaccagtatagcttcgccccagatggggaggcccggctggtgagccgctgccctgcagacaatcctggcctcgtccaggcccagcccagagtgccactcacccccacccgagggaccagcagtagggtggctgtccagaggggtgtaggcagtgggccacatccccctgacacacagcagccctctcccagcaaagcgttcaaacccaggtttccaggagaccaggttgtgaatggagccggcccagagctgagcacaggcccctccccaggctcgcccaccctggacatcgaccagtccatcgagcagctcaacaggctgatcctggagctggatcccaccttcgagcccatccctacccacatgaacgccctcggtagccaggccaatggctctgtgtctccagacagcgtgggaggtgggctccgggcaagcagcaggctgcctgacacaggagagggccccagcagggccaccgggcggcaaggctcctctgctgaacagcccctgggcgggagactcaggaagctgagcctggggcagtacgacaacgatgctggggggcagctgcccttctccaaatgtgcatggggaaaggctggtgtggactatgccccaaacctgccgccattcccctcaccagcggacgtcaaagagacgatgacccctggctatccccaggacctcgatattatcgatggcagaattttaagtagcaaggagtccatgtgttcaactccagcatttcctgtgtctccagagacaccgtatgtgaaaacagcgctgcgccatcctccgttcagcccacctgagcccccgctgagcagcccagccagtcagcacaaaggaggacgtgaaccacgaagctgccctgagacgctcactcacgctgtggggatgtcagagagccccatcggacccaaatccacgatgctccgggctgatgcgtcctcgacgccctcctttcagcaggcttttgcttcttcctgcaccatttccagcaacggccctgggcagaggagagagagctcctcttctgcagaacgccagtgggtggagagcagccccaagcccatggtttccctgctggggagcggccggcccaccggaagtcccctcagcgctgagttctccggtaccaggaaggactccccagtgctgtcctgcttcccgccgtcagagctccaggctcctttccacagccatgagctgtccctagcagagccaccggactccctggcgcctcccagcagccaggccttcctgggcttcggcaccgccccagtgggaagtggccttccgcccgaggaggacctgggggccttgctggccaattctcatggagcgtcaccgacccccagcatcccgctgacagcgacaggggctgccgacaatggcttcctgtcccacaactttctcacggtggcgcctggacacagcagccaccacagtccaggcctgcagggccagggtgtgaccctgcccgggcagccacccctccctgagaagaagcgggcctcggagggggatcgttctttgggctcagtctctccctcctccagtggcttctccagcccgcacagcgggagcaccatcagtatccccttcccaaatgtccttcccgacttttccaaggcttcagaagc

SEQ ID NO: 190134 - DNA, 4067 bp, Homo sapiens
  Payload ID: 17542
  Gene Symbol: TNS4
  Gene Name: tensin 4
  Uniprot ID: Q8IZW8
  ENST ID: ENST00000254051
  CDS Start-End: 160-2307
ctgagtcgtcttggtcccaggagccagtagtgaaggcaacagtctgcccacctgtggacaccagatcctgggagctcctggttagcaagtgagatctctgggatgtcagtgaggctggttgaagaccagaggtaaactgcagaggtcaccacccccaccatgtcccaggtgatgtccagcccactgctggcaggaggccatgctgtcagcttggcgccttgtgatgagcccaggaggaccctgcacccagcacccagccccagcctgccaccccagtgttcttactacaccacggaaggctggggagcccaggccctgatggcccccgtgccctgcatggggccccctggccgactccagcaagccccacaggtggaggccaaagccacctgcttcctgccgtcccctggtgagaaggccttggggaccccagaggaccttgactcctacattgacttctcactggagagcctcaatcagatgatcctggaactggaccccaccttccagctgcttcccccagggactgggggctcccaggctgagctggcccagagcaccatgtcaatgagaaagaaggaggaatctgaagccttggacataaagtacatcgaggtgacctccgccagatcaaggtgccacgatggcccccagcactgctccagcccctctgtcaccccgcccttcggctcccttcgcagtggtggcctcctcctttccagagacgtcccccgagagacacgaagcagcagtgagagcctcatcttctctgggaaccagggcagggggcaccagcgccctctgcccccctcagagggtctctcccctcgacccccaaattcccccagcatctcaatcccttgcatggggagcaaggcctcgagcccccatggtttgggctccccgctggtggcttctccaagactggagaagcggctgggaggcctggccccacagcggggcagcaggatctctgtgctgtcagccagcccagtgtctgatgtcagctatatgtttggaagcagccagtccctcctgcactccagcaactccagccatcagtcatcttccagatccttggaaagtccagccaactcttcctccagcctccacagccttggctcagtgtccctgtgtacaagacccagtgacttccaggctcccagaaaccccaccctaaccatgggccaacccagaacaccccactctccaccactggccaaagaacatgccagcagctgccccccatccatcaccaactccatggtggacatacccattgtgctgatcaacggctgcccagaaccagggtcttctccaccccagcggaccccaggacaccagaactccgttcaacctggagctgcttctcccagcaacccctgtccagccaccaggagcaacagccagaccctgtcagatgccccctttaccacatgcccagagggtcccgccagggacatgcagcccaccatgaagttcgtgatggacacatctaaatactggtttaagccaaacatcacccgagagcaagcaatcgagctgctgaggaaggaggagccaggggcttttgtcataagggacagctcttcataccgaggctccttcggcctggccctgaaggtgcaggaggttcccgcgtctgctcagagtcgaccaggtgaggacagcaatgacctcatccgacacttcctcatcgagtcgtctgccaaaggagtgcatctcaaaggagcagatgaggagccctactttgggagcctctctgccttcgtgtgccagcattccatcatggccctggccctgccctgcaaactcaccatcccacagagagaactgggaggtgcagatggggcctcggactctacagacagcccagcctcctgccagaagaaatctgcgggctgccacaccctgtacctgagctcagtgagcgtggagaccctgactggagccctggccgtgcagaaagccatctccaccacctttgagagggacatcctccccacgcccaccgtggtccacttcaaagtcacagagcagggcatcactctgactgatgtccagaggaaggtgtttttccggcgccattacccactcaccaccctccgcttctgtggtatggaccctgagcaacggaagtggcagaagtactgcaaaccctcctggatctttgggtttgtggccaagagccagacagagcctcaggagaacgtatgccacctctttgcggagtatgacatggtccagccagcctcgcaggtcatcggcctggtgactgctctgctgcaggacgcagaaaggatgtaggggagagactgcctgtgcacctaaccaacacctccaggggctcgctaaggagcccccctccaccccctgaatgggtgtggcttgtggccatattgacagaccaatctatgggactagggggattggcatcaagttgacacccttgaacctgctatggccttcagcagtcaccatcatccagaccccccgggcctcagtttcctcaatcatagaagaagaccaatagacaagatcagctgttcttagatgctggtgggcatttgaacatgctcctccatgattctgaagcatgcacacctctgaagacccctgcatgaaaataacctccaaggaccctctgaccccatcgacctgggccctgcccacacaacagtctgagcaagagacctgcagcccctgtttcgtggcagacagcaggtgcctggcggtgacccacggggctcctggcttgcagctggtgatggtcaagaactgactacaaaacaggaatggatagactctatttccttccatatctgttcctctgttccttttcccactttctgggtggctttttgggtccacccagccaggatgctgcaggccaagctgggtgtggtatttagggcagctcagcagggggaacttgtccccatggtcagaggagacccagctgtcctgcacccccttgcagatgagtatcaccccatcttttctttccacttggtttttatttttatttttttttgagacagagtctcactgtcacccaggctgaactgcagtggtgtgatctaggctcactgcaacctccacctcccaggttcaagcaattatcctgcctcaggctcccaagtagctgggattacaggcatgtgcaactcacccagctaattttgtatttttagtagagacagggtttcaccatgttggccaggctggtcttgaactcctgaccgcaggtaatccacctgcttcggcctcccaaagtgctgggattacaggcgcaagccacccagcccagcttctttccattccttgataggcgagtattccaaagctggtatcgtagctgccctaatgttgcatattaggcggcgggggcagagataagggccatctctctgtgattctgcctcagctcctgtcttgctgagccctcccccaacccacgctccaacacacacacacacacacacacacacacacacacacacacacacacacacacacacacacgcccctctactgctatgtggcttcaaccagcctcacagccacacgggggaagcagagagtcaagaatgcaaagaggccgcttccctaagaggcttggaggagctgggctctatcccacacccacccccaccccacccccacccagcctccagaagctggaaccatttctcccgcaggcctgagttcctaaggaaaccaccctaccggggtggaagggagggtcagggaagaaacccactcttgctctacgaggagcaagtgcctgccccctcccagcagccagccctgccaaagttgcattatctttggccaaggctgggcctgacggttatgatttcagccctgggcctgcaggagaggctgagaccagcccacccagccagtggtcgagcactgccccgccgccaaagtctgcagaatgtgagatgaggttctcaaggtcacaggccccagtcccagcctgggggctggcagaggcccccatatactctgctacagctcctatcatgaaaaataaaatgtttgtctttgcaaaacagtaa

SEQ ID NO: 190135 - DNA, 599 bp, Homo sapiens
  Payload ID: 17542
  Gene Symbol: TNS4
  Gene Name: tensin 4
  ENST ID: ENST00000582747
  CDS Start-End: 1-100
ggtgtttttccggcgccattacccactcaccaccctccgcttctgtggtatggaccctgagcaacggaagtggcagaagtactgcaaaccctcctggtaaggccttcctgtctcagggccccaaacccaacatggggagggaactgcagaaggaaagaggcaccattctgactttaatagtccaaagtgttgatgagggcacaggccctggtcctcagggagctcccatctgatgggaaagactttgactgccctcagagcctctgggctgttgggggtgacatgagcctgggagccctcaatcttctgcaagaggcacaggctctaacttcagggagcctcaagctattggaatgtcccagtctgatgatcaagatgcatccttgccctcagggagcttccactctaatggggaatgcacaggtcctgtcctcaaggagccctcactcaaaacaaaggaaacccagagcttgaactcagaaatctcccagtctgacgggagaggcatctccttccccagggagccccaccataaggaggtgctggagtcaattggctaagggaggggcagggaggaatgagatgcaggctgagggccc

SEQ ID NO: 190136 - DNA, 2513 bp, Homo sapiens
  Payload ID: 17543
  Gene Symbol: TDGF1
  Gene Name: teratocarcinoma-derived growth factor 1
  Uniprot ID: P13385
  ENST ID: ENST00000296145
  CDS Start-End: 734-1300
tctatctcagtttcaagcttcctagtcttccccacacacacacacctagctcctcaggcggagagcacccctttcttggccacccgggtatcccccagggggagtacggggctcaaaacacccttctggaaaaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttgattagagaaactgatttttcttttttctttttttttcccaaaagagtacctctgatcattttagcctgcaactaatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaa

SEQ ID NO: 190137 - DNA, 1771 bp, Homo sapiens
  Payload ID: 17543
  Gene Symbol: TDGF1
  Gene Name: teratocarcinoma-derived growth factor 1
  ENST ID: ENST00000542931
  CDS Start-End: 43-561
cctggatgttcaagggaacaatgacagagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacct

SEQ ID NO: 190138 - DNA, 1852 bp, Homo sapiens
  Payload ID: 17544
  Gene Symbol: TINF2
  Gene Name: TERF1 (TRF1)-interacting nuclear factor 2
  Uniprot ID: Q9BSI4
  ENST ID: ENST00000267415
  CDS Start-End: 343-1698
ctcttaccgcccttttccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagaattgcttggattgctacatggaccccctgagactatcattattacctcctagggccaggaagccagtgtgtcctccgtctctgtgcagctccgtcattaccataggggacttggttttagactctgatgaggaagaaaatggccagggggaaggaaaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 190139 - DNA, 2168 bp, Homo sapiens
  Payload ID: 17544
  Gene Symbol: TINF2
  Gene Name: TERF1 (TRF1)-interacting nuclear factor 2
  Uniprot ID: Q9BSI4
  ENST ID: ENST00000399423
  CDS Start-End: 332-1396
cttttccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 190140 - DNA, 894 bp, Homo sapiens
  Payload ID: 17544
  Gene Symbol: TINF2
  Gene Name: TERF1 (TRF1)-interacting nuclear factor 2
  ENST ID: ENST00000558476
  CDS Start-End: 456-894
gctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatc

SEQ ID NO: 190141 - DNA, 1559 bp, Homo sapiens
  Payload ID: 17544
  Gene Symbol: TINF2
  Gene Name: TERF1 (TRF1)-interacting nuclear factor 2
  ENST ID: ENST00000559969
  CDS Start-End: 1-823
cgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcaggaacttgaacaagagtatggggaaccctttctggctgccatggaaaagctgctttttgagtacttgtgtcagctggagaaagcactgcctacaccgcaggcacagcagcttcaggatgtgctgagttggatgcagcctggagtctctatcacctcttctcttgcctggagacaatatggtgtggacatggggtggctgcttccagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagaaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatattt

SEQ ID NO: 190142 - DNA, 1874 bp, Homo sapiens
  Payload ID: 17544
  Gene Symbol: TINF2
  Gene Name: TERF1 (TRF1)-interacting nuclear factor 2
  ENST ID: ENST00000558566
  CDS Start-End: 282-704
cgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaata

SEQ ID NO: 190143 - DNA, 637 bp, Homo sapiens
  Payload ID: 17544
  Gene Symbol: TINF2
  Gene Name: TERF1 (TRF1)-interacting nuclear factor 2
  ENST ID: ENST00000560019
  CDS Start-End: 1-258
gggggaagggctctgaaggagaacccagttgacttgcctgccacagagcaaaaggagaattgcttggattgctacatggaccccctgagactatcattattacctcctagggccaggaagccagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaa

SEQ ID NO: 190144 - DNA, 499 bp, Homo sapiens
  Payload ID: 17544
  Gene Symbol: TINF2
  Gene Name: TERF1 (TRF1)-interacting nuclear factor 2
  ENST ID: ENST00000557921
  CDS Start-End: 227-499
ggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaagacaaagcaggatctgaggaagattttggaggcacaggaaactttttaccagcaggtgaagcagctgtcagaggctcctgtg

SEQ ID NO: 190145 - DNA, 885 bp, Homo sapiens
  Payload ID: 17544
  Gene Symbol: TINF2
  Gene Name: TERF1 (TRF1)-interacting nuclear factor 2
  ENST ID: ENST00000559019
  CDS Start-End: 301-516
gccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgcc

SEQ ID NO: 190146 - DNA, 1643 bp, Homo sapiens
  Payload ID: 17544
  Gene Symbol: TINF2
  Gene Name: TERF1 (TRF1)-interacting nuclear factor 2
  ENST ID: ENST00000626689
  CDS Start-End: 343-765
ctcttaccgcccttttccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtggtggtggagctgatcctgcagggccggccttgggcccaagtcctgaaagccctgaatcaccactttccagaatctggacctatagtgcgggatcccaaggctacaaagcaggatctgaggaagattttggaggcacaggaaactttttaccagcaggtgaagcagctgtcagaggctcctgtggatttggcctcgaagctgcagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagaattgcttggattgctacatggaccccctgagactatcattattacctcctagggccaggaagccagtgtgtcctccgtctctgtgcagctccgtcattaccataggggacttggttttagactctgatgaggaagaaaatggccagggggaaggaaaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgtt

SEQ ID NO: 190147 - DNA, 533 bp, Homo sapiens
  Payload ID: 17545
  Gene Symbol: TUT1
  Gene Name: terminal uridylyl transferase 1, U6 snRNA-specific
  ENST ID: ENST00000278279
  CDS Start-End: 39-533
agaggtgcttgtgtttttgtcggtacaggagagtcgctatggcggcggtggattcggatgtcgaatcgctgccgcgtggggggttccgctgctgcctctgccacgttactacagccaaccgacccagccttgatgcccacttgggaggcagaaagcaccggcacctggtagaactacgagctgcgagaaaggcccagggacttcgaagtgtgtttgtcagtggctttcccagggatgtggattctgctcagctctctgagtacttcctagcatttggacctgtggccagtgttgtcatggacaaggacaagccagtcccaaaggctccagaatctccatcgctggactcggccctggcttccccactggaccctcaagccctggcctgcaccccagcttcccctccagattcacaacctcctgcttctccccaggattctgaagccctggactttgaaaccccttcctcctccctggcgccccaaactccggactctgccttggcctccgagacccttgcttctccccagtct

SEQ ID NO: 190148 - DNA, 2826 bp, Homo sapiens
  Payload ID: 17545
  Gene Symbol: TUT1
  Gene Name: terminal uridylyl transferase 1, U6 snRNA-specific
  ENST ID: ENST00000308436
  CDS Start-End: 39-2777
gtttccggaggagtgtgtccgcgcaattgaacgactttatgtcacttcctatcggatcggcggaagttgcttccgagcgcgttgagctttggcgaagtgggttccggtggtggcagaggtgcttgtgtttttgtcggtacaggagagtcgctatggcggcggtggattcggatgtcgaatcgctgccgcgtggggggttccgctgctgcctctgccacgttactacagccaaccgacccagccttgatgcccacttgggaggcagaaagcaccggcacctggtagaactacgagctgcgagaaaggcccagggacttcgaagtgtgtttgtcagtggctttcccagggatgtggattctgctcagctctctgagtacttcctagcatttggacctgtggccagtgttgtcatggacaaggacaagggagtgtttgccattgtggagatgggggacgtgggtgctcgagaggctgtcttgtcacagtcccagcacagcctgggaggacatcgcctgcgtgtccgcccacgggagcagaaggagttccagagcccggcctccaaatcccccaaaggagcggcccccgacagtcaccagctggccaaagcgctagctgaggctgcagacgtgggggcacaaatgataaagcttgtggggctgagggagttgtccgaggccgagcggcagcttcgcagcctagtggtggccctgatgcaggaggtcttcacagagttcttccctggctgtgtggtccacccttttggctcttccataaatagcttcgatgtccatggctgtgatcttgacctcttcttggatctgggtgacttggaagagccccagccagtcccaaaggctccagaatctccatcgctggactcggccctggcttccccactggaccctcaagccctggcctgcaccccagcttcccctccagattcacaacctcctgcttctccccaggattctgaagccctggactttgaaaccccttcctcctccctggcgccccaaactccggactctgccttggcctccgagacccttgcttctccccagtctctgcctccagcttcaccactgctagaggacagggaagagggggacctggggaaggcctcggaactagcagagaccccaaaggaggagaaagcagagggggcagcaatgctggagctggtgggatccattctccggggctgtgtccctggggtgtatcgagtccaaactgtgccctctgcccggcgccctgtggtcaagttctgtcatcggccttcaggtctccacggtgatgtctccctcagtaaccggctggccctgcataactcccgtttcctgagtctctgctctgagctggatggtcgagtccggcccctcgtgtacaccctccgctgctgggctcagggtcgggggctgtcagggagtggcccccttctcagtaactacgccctgaccttgctggtgatctattttcttcagaccagggaccctcctgtgttgcccactgtgtcccagctcacccagaaagcaggagagggggaacaggtggaagtcgatggctgggactgcagtttccccagggatgcctcaagactggagcccagcataaatgtggagcccctcagttccctgctagcccagttcttctcctgtgtatcttgttgggatcttcgtggctccctgctgtccctgcgggagggtcaggcactgcctgtggcagggggcctgccttctaatctctgggagggtctgcgccttggccccctgaatctccaggacccttttgacctgagtcacaatgtcgcagccaatgtgaccagccgggtggctgggcgcctacagaactgctgccgagcagcagccaattactgccgaagcctccagtaccagcgccgttcctcccggggtcgggactgggggctgctccctcttctgcagcccagctcccccagctccctgctctctgctacgccgatccctttaccccttgcacccttcacccagctcactgctgccctggtgcaggtattcagggaagcactggggtgccatatagaacaggcaaccaagagaacgcggtcagaaggaggtggaactggggagtcctctcagggagggacaagcaaaagactcaaagtagatggacagaaaaactgctgtgaggaggggaaagaggagcagcagggatgtgcaggggacggtggggaagacagggtagaagagatggttatagaggttggagagatggtgcaggactgggccatgcagagccctgggcagccaggggacctgcccctgaccactggaaagcatggagcccctggagaagaggggcagcccagccacgcagccctggcagagcgggggcccaagggacatgaggcagcccaagaatggtctcagggtgaggcagggaagggggcatccctgccctcctcagcgagctggcgctgtgccttgtggcaccgagtgtggcaagggcggcggcgagcccgtagacgcttgcagcagcaaaccaaggagggagctggaggtggcgctggcacaagagcagggtggctggcgactgaggctcaggtcacccaggagctgaaaggactgagtggtggcgaagagaggccagaaactgagcccctgctgagctttgtggcgtctgtctccccggctgaccgaatgctcactgtgaccccgctccaggatccccaaggcctgttccctgatctccatcatttcttacaggttttcctccctcaagcaattcgacatctcaagtgaagacatggcccctgaagggcaataaagctgctagtttattaatacagtc

SEQ ID NO: 190149 - DNA, 3363 bp, Homo sapiens
  Payload ID: 17545
  Gene Symbol: TUT1
  Gene Name: terminal uridylyl transferase 1, U6 snRNA-specific
  Uniprot ID: Q9H6E5
  ENST ID: ENST00000476907
  CDS Start-End: 693-3317
gaggtgcgccagtagctctggcgcctccggcgtacaccacgcagcccactactgcggaaggaatgggcctggctccaggacctcgtggagtccggaaggtgcccggtggtggcagagctccccaaccagggctagaagccgtcgcagaacacccgttttgcgggaggacagggggcggagggagggagtaacagccctgaaaaggttggaagtccagggacagccctgggctccgtggggcaaagaattggaagccgccgatcctccgcctttattcgtcgggtaaataagggtcgagggtacagacgcacgggtgtctactgcggggtgaaggagctgccgcaagatgccacccggcgccggcctttgtggctgctgtcatgaatattcacgatgctttgggccaatcaacgtctgaacagcttaaagcacaccaatcggcttaccgcatgcagataagcatcgtaacgcgccgcttttcctgaaacgggcggggactggacagcggctagaaacggaacccagagtcgaaggagcttggtttccggaggagtgtgtccgcgcaattgaacgactttatgtcacttcctatcggatcggcggaagttgcttccgagcgcgttgagctttggcgaagtgggttccggtggtggcagaggtgcttgtgtttttgtcggtacaggagagtcgctatggcggcggtggattcggatgtcgaatcgctgccgcgtggggggttccgctgctgcctctgccacgttactacagccaaccgacccagccttgatgcccacttgggaggcagaaagcaccggcacctggtagaactacgagctgcgagaaaggcccagggacttcgaagtgtgtttgtcagtggctttcccagggatgtggattctgctcagctctctgagtacttcctagcatttggacctgtggccagtgttgtcatggacaaggacaagggagtgtttgccattgtggagatgggggacgtgggtgctcgagaggctgtcttgtcacagtcccagcacagcctgggaggacatcgcctgcgtgtccgcccacgggagcagaaggagttccagagcccggcctccaaatcccccaaaggagcggcccccgacagtcaccagctggccaaagcgctagctgaggctgcagacgtgggggcacaaatgataaagcttgtggggctgagggagttgtccgaggccgagcggcagcttcgcagcctagtggtggccctgatgcaggaggtcttcacagagttcttccctggctgtgtggtccacccttttggctcttccataaatagcttcgatgtccatggctgtgatcttgacctcttcttggatctgggtgacttggaagagccccagccagtcccaaaggctccagaatctccatcgctggactcggccctggcttccccactggaccctcaagccctggcctgcaccccagcttcccctccagattcacaacctcctgcttctccccaggattctgaagccctggactttgaaaccccttcctcctccctggcgccccaaactccggactctgccttggcctccgagacccttgcttctccccagtctctgcctccagcttcaccactgctagaggacagggaagagggggacctggggaaggcctcggaactagcagagaccccaaaggaggagaaagcagagggggcagcaatgctggagctggtgggatccattctccggggctgtgtccctggggtgtatcgagtccaaactgtgccctctgcccggcgccctgtggtcaagttctgtcatcggccttcaggtctccacggtgatgtctccctcagtaaccggctggccctgcataactcccgtttcctgagtctctgctctgagctggatggtcgagtccggcccctcgtgtacaccctccgctgctgggctcagggtcgggggctgtcagggagtggcccccttctcagtaactacgccctgaccttgctggtgatctattttcttcagaccagggaccctcctgtgttgcccactgtgtcccagctcacccagaaagcaggagagggggaacaggtggaagtcgatggctgggactgcagtttccccagggatgcctcaagactggagcccagcataaatgtggagcccctcagttccctgctagcccagttcttctcctgtgtatcttgttgggatcttcgtggctccctgctgtccctgcgggagggtcaggcactgcctgtggcagggggcctgccttctaatctctgggagggtctgcgccttggccccctgaatctccaggacccttttgacctgagtcacaatgtcgcagccaatgtgaccagccgggtggctgggcgcctacagaactgctgccgagcagcagccaattactgccgaagcctccagtaccagcgccgttcctcccggggtcgggactgggggctgctccctcttctgcagcccagctcccccagctccctgctctctgctacgccgatccctttaccccttgcacccttcacccagctcactgctgccctggtgcaggtattcagggaagcactggggtgccatatagaacaggcaaccaagagaacgcggtcagaaggaggtggaactggggagtcctctcagggagggacaagcaaaagactcaaagtagatggacagaaaaactgctgtgaggaggggaaagaggagcagcagggatgtgcaggggacggtggggaagacagggtagaagagatggttatagaggttggagagatggtgcaggactgggccatgcagagccctgggcagccaggggacctgcccctgaccactggaaagcatggagcccctggagaagaggggcagcccagccacgcagccctggcagagcgggggcccaagggacatgaggcagcccaagaatggtctcagggtgaggcagggaagggggcatccctgccctcctcagcgagctggcgctgtgccttgtggcaccgagtgtggcaagggcggcggcgagcccgtagacgcttgcagcagcaaaccaaggagggagctggaggtggcgctggcacaagagcagggtggctggcgactgaggctcaggtcacccaggagctgaaaggactgagtggtggcgaagagaggccagaaactgagcccctgctgagctttgtggcgtctgtctccccggctgaccgaatgctcactgtgaccccgctccaggatccccaaggcctgttccctgatctccatcatttcttacaggttttcctccctcaagcaattcgacatctcaagtgaagacatggcccctgaagggcaataaagctgctagtttattaataca

SEQ ID NO: 190150 - DNA, 643 bp, Homo sapiens
  Payload ID: 17545
  Gene Symbol: TUT1
  Gene Name: terminal uridylyl transferase 1, U6 snRNA-specific
  ENST ID: ENST00000478537
  CDS Start-End: 39-341
agaggtgcttgtgtttttgtcggtacaggagagtcgctatggcggcggtggattcggatgtcgaatcgctgccgcgtggggggttccgctgctgcctctgccacgttactacagccaaccgacccagccttgatgcccacttgggaggcagaaagcaccggcacctggtagaactacgagctgcgagaaaggcccagggacttcgaagtgtgtttgtcagtggctttcccagggatgtggattctgctcagctctctgagtacttcctagcatttggacctgtggccagtgttgtcatggacaaggacaagggtctcgctgtctctcaggctggtgtgtagtggtgcaatcacaatcacagctcactgcagcctcaacatcctgggcccaagtgatgctcttatcatagcctcccaagtaattggaactacagggagtgtttgccattgtggagatgggggacgtgggtgctcgagaggctgtcttgtcacagtcccagcacagcctgggaggacatcgcctgcgtgtccgcccacgggagcagaaggagttccagagcccggcctccaaatcccccaaaggagcggcccccgacagtcaccagctggccaaagcgctagctgaggctgcagacgtgggggca

SEQ ID NO: 190151 - DNA, 699 bp, Homo sapiens
  Payload ID: 17545
  Gene Symbol: TUT1
  Gene Name: terminal uridylyl transferase 1, U6 snRNA-specific
  ENST ID: ENST00000494385
  CDS Start-End: 270-699
attgaacgactttatgtcacttcctatcggatcggcggaagttgcttccgagcgcgttgagctttggcgaagtgggttccggtggtggcagaggacccagccttgatgcccacttgggaggcagaaagcaccggcacctggtagaactacgagctgcgagaaaggcccagggacttcgaagtgtgtttgtcagtggctttcccagggatgtggattctgctcagctctctgagtacttcctagcatttggacctgtggccagtgttgtcatggacaaggacaagggagtgtttgccattgtggagatgggggacgtgggtgctcgagaggctgtcttgtcacagtcccagcacagcctgggaggacatcgcctgcgtgtccgcccacgggagcagaaggagttccagagcccggcctccaaatcccccaaaggagcggcccccgacagtcaccagctggccaaagcgctagctgaggctgcagacgtgggggcacaaatgataaagcttgtggggctgagggagttgtccgaggccgagcggcagcttcgcagcctagtggtggccctgatgcaggaggtcttcacagagttcttccctggctgtgtggtccacccttttggctcttccataaatagcttcgatgtccatggctgtgatcttgacctcttcttggatctgggtgacttggaagagcccc

SEQ ID NO: 190152 - DNA, 1041 bp, Homo sapiens
  Payload ID: 17546
  Gene Symbol: TESC
  Gene Name: tescalcin
  Uniprot ID: Q96BS2
  ENST ID: ENST00000335209
  CDS Start-End: 188-832
accgcggcgcgccgccctccgccgttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaaggtttgttaatta

SEQ ID NO: 190153 - DNA, 854 bp, Homo sapiens
  Payload ID: 17546
  Gene Symbol: TESC
  Gene Name: tescalcin
  ENST ID: ENST00000462502
  CDS Start-End: 127-534
cggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatcttgtggcttcctgggactagaagggggttgtgcggtggatgtgaaacaaggcccttgatgcaaagacctgggttccagtgtggcccgtctcaccagccatgtgaccttgaaccttgacccagaacgtggttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggtgagcgcccctgcagccctcccgagacgcgcagtgcctttcccgcttatggtctgcgtttctggaaggcctcatgggg

SEQ ID NO: 190154 - DNA, 1057 bp, Homo sapiens
  Payload ID: 17546
  Gene Symbol: TESC
  Gene Name: tescalcin
  Uniprot ID: Q96BS2
  ENST ID: ENST00000470612
  CDS Start-End: 198-689
gtgcgctaggaccgcggcgcgccgccctccgccgttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtaaagtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaaggtttgttaattaa

SEQ ID NO: 190155 - DNA, 936 bp, Homo sapiens
  Payload ID: 17546
  Gene Symbol: TESC
  Gene Name: tescalcin
  Uniprot ID: Q96BS2
  ENST ID: ENST00000541210
  CDS Start-End: 165-728
gttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaaggtttgttaatt

SEQ ID NO: 190156 - DNA, 422 bp, Homo sapiens
  Payload ID: 17546
  Gene Symbol: TESC
  Gene Name: tescalcin
  ENST ID: ENST00000549210
  CDS Start-End: 1-246
ccacatgtacgactcggacagcgacggccgcatcactctggaagaatatcgaaatgtaaagtggtcgaggagctgctgtcgggaaaccctcacatcgagaaggagtccgctcgctccatcgccgacggggccatgatggaggcggccagcgtgtgcatggggcagatgatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatc

SEQ ID NO: 190157 - DNA, 2782 bp, Homo sapiens
  Payload ID: 17547
  Gene Symbol: TES
  Gene Name: testin LIM domain protein
  Uniprot ID: Q9UGI8
  ENST ID: ENST00000358204
  CDS Start-End: 216-1481
attggctgcccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttatttttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaa

SEQ ID NO: 190158 - DNA, 2763 bp, Homo sapiens
  Payload ID: 17547
  Gene Symbol: TES
  Gene Name: testin LIM domain protein
  Uniprot ID: Q9UGI8
  ENST ID: ENST00000393481
  CDS Start-End: 224-1462
aataaataggaggttttgagggctgtttatgagcgcattccattacagtgtctttcagcggagccagagctcagccaatcctaattaagaagcaatttcagctgcagtcattgcttattataataattgtgacatttttatagccctacattgtctttctcaaagtaacggattcaggaggagtccttttctgagtagagtccacagaagaggtattctattgatgggcttaggtcacgagcaaggatttggagccccttgtttaaaatgcaaagaaaaatgtgaaggattcgaactgcacttctggagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgccatgagttgtctcccagagaggtgaaggagatggagcagtttgtgaagaaatataagagcgaagctctgggagtaggagatgtcaaacttccctgtgagatggatgcccaaggccccaaacaaatgaacattcctggaggggatagaagcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttggtttaagcatttgatttgtaaaacagtaaataattgtatctttccatagcttttcaaatgtgaaatcatttttggaagcttggatctcattaaacttcatgtctctattccatttgtgccacacacttaaaagttagtgtactgaatggaaagatgagcattcctagttctacacttcttttttccccctcatgtgtaaaatgaaaagaaaactaaatttgccctaataccaaggcgctacgtttattgcctcgtcttattcactgacctttgtaatgatacacagtgaattctttttgacaaagagaaatgcagtgtagtatgcagagctgctgttttaatgcctatgcatttactctttcctgatttaggcagaggtggcattttctttattgcatttctctatttttttaatgtaccctaccttcagtattctctttgtaagttggtgacttgcatctgtggccttgaatattttattatcacatgtggcataacagtatccacactttttagttctttatttttttttttttattttgagcaattctcctgcctcagcctcccaaatagctgggattacaggtgcatgccaccacacccagctaatttttgtatttttagtagagacaggttttcaccatgttagccaggctggtctcaaactcctgacctcagatgatccgcctgccttggcctcccaaagtgctgggattacaggtgtgggagccaccatgcctgacccacacactttttacttgtatagatgatttttggcttggacataaaagccaagccacccatttgcttttaatccaaagaacatgtatagtttttgtacccagagactatgatttatattgattgcacttgcctgccatgatttagataagattttttttgcatggtttttattctttcctaatggatcctgttttataatacttccaagcctgtccatggatatatcaaatgtcttcacttgtatattttcatggctaggtatttctaatgtttattcttccctgtgtacttctacacatagctatgcactatgaaaattaaatggaatgaatgatatgtatattactcaaaataaagtttctttcactttaa

SEQ ID NO: 190159 - DNA, 699 bp, Homo sapiens
  Payload ID: 17547
  Gene Symbol: TES
  Gene Name: testin LIM domain protein
  ENST ID: ENST00000393484
  CDS Start-End: 1-578
gcaccccagcagcagtgggggccatggaggacaaatctgctgagcacaaaagaactcaatattcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgagaagtgttctaaggatatggttgcctcagcctgctttaggacttgagtttatgcttttcttaaagcctcttacaaatgggaaacagaaagcagtcctcctaagtagaaagcaaattattcctaccacagggtgttaaaatcaaggcaattcaaaaacaatacatgcattgactatgagccacctcaagatttctacttgtgaaatttacaatatcaattataggtactgcttaataataaaatcctcacttaaaaaaa

SEQ ID NO: 190160 - DNA, 577 bp, Homo sapiens
  Payload ID: 17547
  Gene Symbol: TES
  Gene Name: testin LIM domain protein
  ENST ID: ENST00000455989
  CDS Start-End: 339-577
gctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagaaaaatatgtcgtaactgcaagtgtggccaagaagagcatgatgtcctcttgagcaatgaagaggatcgaaaagtgggaaaactttttgaagacaccaagtataccactctgattgcaaaactaaagtcagatggaattcccatgtataaacgcaatgttatgatattgacgaatccagttgctgccaagaagaatgtctccatcaatacagttacctatgagtgggctcctcctgtccagaatcaagcattggccaggcagtacatgcagatgctacccaaggaaaagcagccagtagcaggctcagagggggcacagtaccggaagaagcagctggcaaagcagctccctgcacatgaccaggacccttcaaagtgcca

SEQ ID NO: 190161 - DNA, 1022 bp, Homo sapiens
  Payload ID: 17547
  Gene Symbol: TES
  Gene Name: testin LIM domain protein
  ENST ID: ENST00000492891
  CDS Start-End: 160-294
actgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaagatgggcttaggtcacgagcaaggatttggagccccttgtttaaaatgcaaagaaaaatgtgaaggattcgaactgcacttctggagtcctgctattgctgcaaactgagtatgaaagaaggtgacccagccatctatgccgaaagggctggctatgataaactgtggcacccagcttgttttgtctgcagcacctgccatgaactcctggttgacatgatttatttttggaagaatgagaagctatactgtggcagacattactgtgacagcgagaaaccccgatgtgctggctgtgacgagctgatattcagcaatgagtatacccaggcagaaaaccagaattggcacctgaaacacttctgctgctttgactgtgatagcattctagctggggagatatacgtgatggtcaatgacaagcccgtgtgcaagccctgctatgtgaagaatcacgctgtggtgtgtcaaggatgccacaatgccatcgacccagaagtgcagcgggtgacctataacaatttcagctggcatgcatccacagagtgctttctgtgctcttgctgcagcaaatgcctcattgggcagaagttcatgccagtagaagggatggttttctgttcagtggaatgtaagaagaggatgtcttaggaggagggcacccagaagtatcgagccatagctatccaaagtggtctgcatttctactgtaaaatgcaatttgaaaaaaataaaacgcaaaaaaagaaactgtaaaggaaaccaagagattttgtttaatttttttggccattttttcttcatcaattttttttcggtctcaacttttaaacttgg

SEQ ID NO: 190162 - DNA, 5334 bp, Homo sapiens
  Payload ID: 17548
  Gene Symbol: TOPAZ1
  Gene Name: testis and ovary specific PAZ domain containing 1
  Uniprot ID: Q8N9V7
  ENST ID: ENST00000309765
  CDS Start-End: 169-5247
acttccgcttacgcgccccacttccgcttccggccccgggctgtggtgactggcggtgtggggtgggtcagagggcagtaggtacctccaggcgggagcagcgtttgcaccgcggtgggttcctgcgagctggtgcagaggggccccagcgggccggccccggggcacatgcgacgacctccacccctgggccccacgacggcctcagggcctgaaggcaatgtgcgaaacctgcagaagcggcaggcgccagggccaggcgcggcgggaggctgtggccctgaggccggggggtgccgggaaaataagcaaaagaggagaatggtggcccgggccacccctgggagaggcgaggtggaaagtgataagtcggttgcagcatcaggggctggaaaggccgcaaggcgtcaggtggaggggcgcaggggcccggtgagcccgtcagactcgtcagacccgcgaggcctagaagcagcaaaggaggctgaactccccttgcaaacggaaagacacaccaaggaaaaaagaaaagttactgaagcctcaagtgatgatccacagccagggcttgacttggtaagaaaggaatcattaaccagttcggaatctttccaaacagtggaatgcttgcagtctttgggtaaggaaagtataatagaaggtattaaaagaagaattcgaaataaaaaacttaaaagcttagaaaacccacctctcaaaataaccgaaaatgaggctacacaaaatattaaggttgaattccaagatgaactgtacaagaatactccaaaatattcttgtaatatcttgtcacctgaagtagaaaataattccgttttaaaattacgtgattgcaattgtttcccccattccaagggttgtaatgatgaaaacaacctgccatataaacctgatggtggatgtatgcatgtagcagaaaatttctcaaagaaagaaaaccttaggagtcttgcagagaagagtgacacaaatagtattcctcagctcttacaaacagaagaaaatgtaatgggagtaaataagttactaccagaagagagtgatttataccaaagtaaaaccaatggcttgctttcctgccttcaacatgaaaaaaataaatattcaatagaggagagcagtgttgggcgaaaacccaggaaaaggatgaagttgtctgaaaaagcagatgaaacagttactgagatgaacttctctaatgagtataacaagtctgagttgatgttgcaagaaaatcaaatgattgctgatggtaaagaagcagagactaaaagtcctttaaatgttttgagaaaagtaagccataatacagtctctttgatggatcatttattaagtgtcccagaaacagtagaaaaagaaacaagttctgaacatcatgtaaatgctgtgtttcagaaaaccattgaaccacttttgaaagaagaaacagagaatgcttcagagccgttaggttatgaaagcatggcatcgaaagaggattttaaatcgatgaaaagcttcatagggaaatcacctaatgagtaccatattgaaaggagatcttcacgggaagacttaagaagtgcatctgaagaattgaagttaagctgtcagagaacaatacctatgactggtaaaagaacttggccctattattcatgtgctagaatatctgcctggtgttggaaaaaggcttccttgccagaatcaagttactttcttcgtgggtctcaggaaagttgtaggcaagttgatgtccctaaacaccaaacaaaccagacccatttaactgactccaaattattattacaaagttccttaacagaaacaaacactgaatcttcaagtaaagaaaaattagattctaattctaattgtttgtcttcagtttctgcagtagaacctactttaatggttataaaggaacctataatcaaggatgataaaaagataaaatcagaggaactgagcagaagagggtcagaggtaatttctaacactactgaagatactcaattaaccagtgagactcaaagcttaacgggaaataaaaaaaaagctagaggaaatttaacgaaacttaatttgacagcgacttccaaagatggtcaggaagcaaataactctgcaggcaaaactattcatcgaaaagcatgcattgctcaacaaacatttatagttccagacttggttaaaatattgaacacaggacggctgactaattttaaaattcctttacttaagaataaatcagaaaaaagaaaagaagtaaatgccaagtcatcagagagagaagcttacagtcctctagaacttctggacaatttatctggagcagacgtaagacagaacaggagtaaagaaaatgtctccatgatgatgttaggacctcaaactttgagcatacgaaatagtgtaactccagtgcaagctagttctgactcattctacaataagaaatcctatagtatttctccaagctttacaaagcaaggtaacaatagcaaaccatctaatcacgtctctgaaccaggcaatattgtttctaataaagaagttgcttctctcacagttgaaaataatgctttttcttgtgatcctgggtatgtagagaaaagtccttccttctgctgtaatgaacaagaaacattccgaccagtgtccagtgaagttaggggtagaaaaataactaagaatttttcagaggtagggtttccagatattcttaaagcatatgaagatgacgtcctcttaattgatgtaattcaagatgacccagacctctttggagtctccaatgaaggggagctctcatttacttctgaggtcccaaagataagccaggagcccaatgttgctggagagcaccaatcaacagactccaagtacatggaaactccagtaaaaaaagaaccaagtgatgacttaagagaacttcctgtactggactgtggatggataaagccagacatctgtgcttccaactcagcagaaagtgaaataaaacgtgatcccaaagatgtaaacacttccttaggagaagttgctaatgagacctctgaaaatgaaacactgggagacttcagtgaacaaataaaaggttcagacttggatgaaaagcatagatttacagacaaagtgattaccaaagaagaaaaagaaaatatttatgaagtttgcaaaagcaaagattctagaaatgcagactttatggtcggcgaatgtcaatttgcagtaccagtcccgaaacctctgtgtttattagtacctcctttgaatctaagtggtcgtcaagaagacacaatactgaatacctggatgaatgatttcagatttctgggaaaacattctgtcctaaagctgcagaatcctgaaacttgtgaaatattcaagagggaaaaaaatgtgggggtgttccagaagtccctagggttgatgataccctataaatattgcaaatttcattttaatacattacgtggctgtgagcgaccactgtgcaagtttgctcatgtgcctgaacaaggggatgaaaaggtttgcatggatgtgtttaagaaatatataaatatcaatgaactgtgtttgctacagcgtgcagtaaacatatttatggagtactacagaaagtttcccccaggtgtatactttgatttacaagtgctaaatgaccttctaaattctttactcaaacattgtttgttgaaagaagtatttcagatagtgaacctcagcataatggttaaaatgctgccttctctgaaaatattactaaacatatttgagtatgtggcaactatgaaattaaggaatgctgtacctgctttaattgatatcttttgcaagcttgttgaagccgggatggtgcttgacccagagcactttaactatattgttaagcttttataccaagtacaagcttccaaacaagaaataactgcagttctggaaatgaaatcgaggttacagatgagacgatttaaaaagaactggaagtgtgatttagattcagccttgaataaattagagcattgtaaagaaaaaggtgactggaccaaattgggaaaattatacattaacgtaaaaatgggctgtgaaaaatttgcagatttccagacattttgtgcttgcattgctgaaacactcacaaaaaactatgaagatgaaagaccagatattcccttttgtgaatttgctgaaacagttagcaaagatccacaaaacagtaaagtagataaaggtgtactgggaagaattggaatcagtgctatgtacttctatcacaagctgttgcagtggtccaagggaaggaaggtcttagagaaactatatgaattaaaaatacactttacaagtttaaaaggacttatagggcctgagaagttagcatcaagatgtcaaattgtgaatgttgcagcagaaatttttctaaaaagtggaagcctagatggtgccatttgggtaatgagggagtcagagtggataatcaatacgcctctgtggccttgtgatagactggatgtgcttaatcgacataatttactctgtacaattgcacatgaaatcttagccaagagcctttatagacagacatttgaagttttgcagaatctaccaggttttcaaaattcccaagaaactgtggaagtctcacaatatagccttctttttaataagcttctaggttcctgtatagaaagcagtagtcttggtatgtcatcctctgtggcagaattcatgatttcaaagagcatccctattgatttttcctttctcagaagattaattacttctttaggaaggagtcgtttatggctcaaagccagagcccactacaaaagtgctctttccttgggttgctacccaccattggaaggaaatttataccgaaaacttcttctaattccatcttatttatctgagattgaaatgctcttagctattgaaatcttcatggtatctaatgctagtagtattcagagtcctggaacttctacacagatactgcagatagttttgaaaaggtgtgaagacaaccagtctcggagcaatgatgattatcaagctgcagtagaaaggttaattatggctgctcgtatatcagatccaaagcttttcgttaaacacatgactgtcaatgttaataaggaacaggtttatagtttggaacattgttctgccctgaaatggttaaaagagaatatgaagtgggctggaaaggtttggcttttcagtaaccattagctaataaagtctgctttttttttttttttagttcaagtaatcattgttgaaaataaaaggcaataaaaatagacagttttcactata

SEQ ID NO: 190163 - DNA, 3395 bp, Homo sapiens
  Payload ID: 17549
  Gene Symbol: TDRP
  Gene Name: testis development related protein
  Uniprot ID: Q86YL5
  ENST ID: ENST00000324079
  CDS Start-End: 242-799
cttggagcgggcctggttctggggatggtttgggggcgggccgggtcctggggagggtttggggcgggcctggtggggagggggcgggcctagttctgggggtgccccgcccccgcctagccccgcccggcccactgggcccgcgtcccgcaggagccgcaggcagagcgtccggcggccgggagggacgcggagccacagcccgacgcacggacggagggacgccggagcccgcctgaccatgtggaagctgggccggggccgagtgctgctggacgagccccccgaggaggaggacggcctgcgtggggggccgccaccggccgccgccgccgccgcccaggcgcaggttcagggagcaagtttccgaggttggaaagaagtgacttcactgtttaacaaagatgatgagcagcatctcctggaaagatgtaaatctcccaagtccaaaggaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctggtgagcatccgacggcagagtaaaggccacctgacagatagcccggaggaggcggagtgaggggggctgcgtggcaagtgtgccccgacatggtggccttttatgagtataccatgtagttgttgagtcttttccgcgttagaaagaatagagagtctactttttgcctatatttgatatttggacctctgtttctttatttaatgaactctcacacacactgtgactccttggtgaacacgtgcagggattgtacatttgattgccttattgcagaaatattcacctatcagtccatgttttgcagaaactggagatgtgaatttatgatgctctcccataatacagcagtaatgatttgcagtttctcacaaaatgattttcatgctgctctgtgttgtagttctgtttcagaacttccgtacctttttcttgtatgtagcacgtataaatgcagctgtcatgcagttcttttcttttgctagaaaattagtcaggaggtaagatgaatcttccaaagttatgttaaattttgtttaacttgacaaattaaactttgttcttattaaacaaatacgtaaacaaatactggaaaagcaaagcttatatttgggagtaaaatgtatcttaaaatgcatgttcatcttttgctgagggaggaatagcttcttgtatgtccactggatagtaacagtggttcttttttggaattttatttttacctcttttgaacttctaaatcggtccctttattttcttaaaacatttgctctcttttttgtttacagattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccggtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatgcaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcataactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctctttccttattggtttgcatgattattggcatctgcttacgatggctttaatcactcagagctaatggcacctttcctatttagcctcattttagaatgcagtcaacacatgtagacttttcacaaataaatgaacaacttcaa

SEQ ID NO: 190164 - DNA, 2465 bp, Homo sapiens
  Payload ID: 17549
  Gene Symbol: TDRP
  Gene Name: testis development related protein
  Uniprot ID: Q86YL5
  ENST ID: ENST00000427263
  CDS Start-End: 89-685
gagccgcaggcagagcgtccggcggccgggagggacgcggagccacagcccgacgcacggacggagggacgccggagcccgcctgaccatgtggaagctgggccggggccgagtgctgctggacgagccccccgaggaggaggacggcctgcgtggggggccgccaccggccgccgccgccgccgcccaggcgcaggttcagggagcaagtttccgaggttggaaagaagtgacttcactgtttaacaaagatgatgagcagcatctcctggaaagatgtaaatctcccaagtccaaaggaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctgattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccggtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatgcaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcataactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctctttccttattggtttgcatgattattggcatctgcttacgatggctttaatcactcagagctaatggcacctttcctatttagcctcattttagaatgcagtcaacacatgtagacttttcacaaataaatgaacaacttcaaccttggttttc

SEQ ID NO: 190165 - DNA, 2622 bp, Homo sapiens
  Payload ID: 17549
  Gene Symbol: TDRP
  Gene Name: testis development related protein
  Uniprot ID: Q86YL5
  ENST ID: ENST00000523656
  CDS Start-End: 257-853
agtccgggccgagcccgcggcgccccaggccccagcggccccaccgcccaccagggctgggcgaggcttcctcccggcgcccccactatcccgcgacctcgggcgccggaggggatgagtcccggatgcccggcgcccaggccccgagggatgccctgaagcgctggggagccgcaggcagagcgtccggcggccgggagggacgcggagccacagcccgacgcacggacggagggacgccggagcccgcctgaccatgtggaagctgggccggggccgagtgctgctggacgagccccccgaggaggaggacggcctgcgtggggggccgccaccggccgccgccgccgccgcccaggcgcaggttcagggagcaagtttccgaggttggaaagaagtgacttcactgtttaacaaagatgatgagcagcatctcctggaaagatgtaaatctcccaagtccaaaggaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctgattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccggtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatgcaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcataactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctctttccttattggtttgcatgattattggcatctgcttacgatggctttaatcactcagagctaatggcacctttcctatttagcctcattttagaatgcagtcaacacatgtagacttttcacaaataaatgaacaacttcaa

SEQ ID NO: 190166 - DNA, 3421 bp, Homo sapiens
  Payload ID: 17549
  Gene Symbol: TDRP
  Gene Name: testis development related protein
  Uniprot ID: Q86YL5
  ENST ID: ENST00000613071
  CDS Start-End: 257-814
agtccgggccgagcccgcggcgccccaggccccagcggccccaccgcccaccagggctgggcgaggcttcctcccggcgcccccactatcccgcgacctcgggcgccggaggggatgagtcccggatgcccggcgcccaggccccgagggatgccctgaagcgctggggagccgcaggcagagcgtccggcggccgggagggacgcggagccacagcccgacgcacggacggagggacgccggagcccgcctgaccatgtggaagctgggccggggccgagtgctgctggacgagccccccgaggaggaggacggcctgcgtggggggccgccaccggccgccgccgccgccgcccaggcgcaggttcagggagcaagtttccgaggttggaaagaagtgacttcactgtttaacaaagatgatgagcagcatctcctggaaagatgtaaatctcccaagtccaaaggaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctggtgagcatccgacggcagagtaaaggccacctgacagatagcccggaggaggcggagtgaggggggctgcgtggcaagtgtgccccgacatggtggccttttatgagtataccatgtagttgttgagtcttttccgcgttagaaagaatagagagtctactttttgcctatatttgatatttggacctctgtttctttatttaatgaactctcacacacactgtgactccttggtgaacacgtgcagggattgtacatttgattgccttattgcagaaatattcacctatcagtccatgttttgcagaaactggagatgtgaatttatgatgctctcccataatacagcagtaatgatttgcagtttctcacaaaatgattttcatgctgctctgtgttgtagttctgtttcagaacttccgtacctttttcttgtatgtagcacgtataaatgcagctgtcatgcagttcttttcttttgctagaaaattagtcaggaggtaagatgaatcttccaaagttatgttaaattttgtttaacttgacaaattaaactttgttcttattaaacaaatacgtaaacaaatactggaaaagcaaagcttatatttgggagtaaaatgtatcttaaaatgcatgttcatcttttgctgagggaggaatagcttcttgtatgtccactggatagtaacagtggttcttttttggaattttatttttacctcttttgaacttctaaatcggtccctttattttcttaaaacatttgctctcttttttgtttacagattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccggtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatgcaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcataactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctctttccttattggtttgcatgattattggcatctgcttacgatggctttaatcactcagagctaatggcacctttcctatttagcctcattttagaatgcagtcaacacatgtagacttttcacaaataaatgaacaacttcaaccttggttttc

SEQ ID NO: 190167 - DNA, 3074 bp, Homo sapiens
  Payload ID: 17550
  Gene Symbol: TEX10
  Gene Name: testis expressed 10
  Uniprot ID: Q9NXF1
  ENST ID: ENST00000374902
  CDS Start-End: 178-2967
gatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaagaa

SEQ ID NO: 190168 - DNA, 824 bp, Homo sapiens
  Payload ID: 17550
  Gene Symbol: TEX10
  Gene Name: testis expressed 10
  ENST ID: ENST00000429235
  CDS Start-End: 311-824
cacctttcaaacatattaagtgaagtgactgctgtgtttacagataaagatgctaatgtacgattagcagcagttcaacttcttcaattcctggcccccaaaatacgagctgaacaaatttctccattttttcctttggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttt

SEQ ID NO: 190169 - DNA, 3006 bp, Homo sapiens
  Payload ID: 17550
  Gene Symbol: TEX10
  Gene Name: testis expressed 10
  Uniprot ID: Q9NXF1
  ENST ID: ENST00000535814
  CDS Start-End: 151-2892
tttgcggagcttcaggtgactgggcgggttcgcctggtttcgggtccgagagagttttagcccggagtgtgtgaatcgggccccacttccccgactctggtcctggccggcgtcccttggagtaggaggaacgatggtttcctaaaacccatgtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaagaagtttacg

SEQ ID NO: 190170 - DNA, 1446 bp, Homo sapiens
  Payload ID: 17551
  Gene Symbol: TEX101
  Gene Name: testis expressed 101
  Uniprot ID: Q9BY14
  ENST ID: ENST00000602198
  CDS Start-End: 443-1246
aaccatccatcccatcagggaaatatgcaacatgcttcaaagaataagaagagaactttgggccagtagagacggggtttcaccgtgttagccaggatggtctcgatctcctgacctcgtgatccgcctgccttggcctcccaaagtgctgggattacagggcactgaatgtcaaagtgaaggaattcaatgaagcccggatcaagggcaggagcaaccgtgaccctcttaaaagagccaatgccccatgtaattagtgacgcgcgcgaatggatagacgctattcccaccgtccctacatagcatccagcgacaccacagccaagggacaggcttggcggaacctgcgggagagaagaaccctctgagcctgattgaaaggcggtgaagagacaggagagggggatcggtgggcggtcccgcctccatcttcagttcccgcatgggggcgaggcagatccagaccagctcctcccagacctctccagaagaagccatgggaacccctcgtatccagcatttgctgatcctcctggtcctaggagcctccctcctgacctcgggcctagagctgtattgtcaaaagggtctgtccatgactgtggaagcagatccagccaatatgtttaactggaccacagaggaagtggagacttgtgacaaaggggcactttgccaggaaaccatactaataattaaagcagggactgagacagccattttggccacgaagggctgcatcccggaaggggaggaggccataacaattgtccagcactcttcacctcccggcctgatcgtgacctcctacagtaactactgtgaggattccttctgtaatgacaaagacagcctgtctcagttttgggagttcagtgagaccacagcttccactgtgtcaacaaccctccattgtccaacctgtgtggctttggggacctgtttcagtgctccttctcttccctgtcccaatggtacaactcgatgctatcaaggaaaacttgagatcactggaggtggcattgagtcgtctgtggaggtcaaaggctgtacagccatgattggctgcaggctgatgtctggaatcttagcagtaggacccatgtttgtgagggaagcgtgcccacatcagctgctcactcaacctcgaaagactgaaaatggggccacctgtcttcccattcctgtttgggggttacagctactgctgccattgctgctgccatcatttattcacttttcctaagaaggcacttctgggcctgggtctgaggacatcttttttgactgggagccttcttactgttgaggttcaacaagctgaggagtagatgggaatttgagggagaatacagagatactatgaacgtatttgacatttttaatacaatttctgctataatttttgtatgcagtaggcgttactaataaacatttctgctgtga

SEQ ID NO: 190171 - DNA, 1112 bp, Homo sapiens
  Payload ID: 17551
  Gene Symbol: TEX101
  Gene Name: testis expressed 101
  Uniprot ID: Q9BY14
  ENST ID: ENST00000598265
  CDS Start-End: 167-916
gaaggcgttccgggcctcaactttggcgtcgtgagattcttgtgaggcgtctgcctggaagccggcagcaattttgcttctttaaagagaaaaagaaggctagggactcagattcctggattctgagatccagaccagctcctcccagacctctccagaagaagccatgggaacccctcgtatccagcatttgctgatcctcctggtcctaggagcctccctcctgacctcgggcctagagctgtattgtcaaaagggtctgtccatgactgtggaagcagatccagccaatatgtttaactggaccacagaggaagtggagacttgtgacaaaggggcactttgccaggaaaccatactaataattaaagcagggactgagacagccattttggccacgaagggctgcatcccggaaggggaggaggccataacaattgtccagcactcttcacctcccggcctgatcgtgacctcctacagtaactactgtgaggattccttctgtaatgacaaagacagcctgtctcagttttgggagttcagtgagaccacagcttccactgtgtcaacaaccctccattgtccaacctgtgtggctttggggacctgtttcagtgctccttctcttccctgtcccaatggtacaactcgatgctatcaaggaaaacttgagatcactggaggtggcattgagtcgtctgtggaggtcaaaggctgtacagccatgattggctgcaggctgatgtctggaatcttagcagtaggacccatgtttgtgagggaagcgtgcccacatcagctgctcactcaacctcgaaagactgaaaatggggccacctgtcttcccattcctgtttgggggttacagctactgctgccattgctgctgccatcatttattcacttttcctaagaaggcacttctgggcctgggtctgaggacatcttttttgactgggagccttcttactgttgaggttcaacaagctgaggagtagatgggaatttgagggagaatacagagatactatgaacgtatttgacatttttaatacaatttctgctataatttttgtatgcagtaggcgttactaataaacatttctgct

SEQ ID NO: 190172 - DNA, 2977 bp, Homo sapiens
  Payload ID: 17552
  Gene Symbol: TEX11
  Gene Name: testis expressed 11
  Uniprot ID: Q8IYF3
  ENST ID: ENST00000344304
  CDS Start-End: 1-2823
atgatctcggctcactgcaacctccgcctcctgtgttcaagcgattcttctgcctcagcctcccaagtagctgggactacagaagttgttgaaaacctggttacaaatgataattcacctaacataccagaggcaattgatagactcttcagcgacatagcaaatatcaacagggagtctatggctgaaataacagacattcagattgaagaaatggcagtaaacctatggaactgggcacttaccataggaggaggttggcttgtaaatgaagagcagaaaattagattacattatgttgcttgcaagttgctgagtatgtgtgaagcctcatttgcctcagaacaaagtattcaacgactgattatgatgaatatgagaataggaaaagaatggttggatgctggaaattttctaatcgctgatgaatgttttcaagctgctgtggccagtctggagcaattatacgtcaaattaattcaaaggagctcccctgaggctgacttgaccatggagaagattactgttgagagtgaccacttcagagtgctttcttaccaagcagagtcagcagttgctcaaggggattttcaaagagcatctatgtgtgtactgcaatgtaaagatatgttgatgaggctcccccagatgacttcaagtcttcatcatctctgttacaactttggagtagaaacccagaagaataataaatatgaagaaagttctttctggcttagccaaagctatgatattgggaagatggataagaaatctactgggccagaaatgctggctaaagttctacggctattagccacgaattatttggattgggatgacaccaaatattatgataaggctctcaatgctgtaaacctagcaaacaaggaacatttaagttctcctgggcttttcttaaaaatgaaaatcctcttgaaaggcgaaacatctaatgaagaactccttgaagctgtcatggaaatactacatcttgacatgcccttagacttctgtctgaacattgctaaactgctgatggatcatgaaagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttagctcaccaaacaggaagacaactgacagcagaatcaatgaactggttacacaacattctgtggagacaagctgccagtagttttgaggtacaaaattacactgatgccctacaatggtactattattctctgaggttttattcaactgatgaaatggatctggacttcaccaagctgcagaggaacatggcttgctgttacctgaatttgcaacaacttgataaggccaaagaggcagtggcagaagctgaacgacatgaccctaggaacgttttcactcaattttatatattcaagattgcagtcatagagggcaactctgaaagagctttgcaggcaataattactttagagaatatattaacagatgaagagtcagaagataatgatctagttgcagagagaggttcacctaccatgcttctaagtttagctgcccagtttgctctagagaatggacaacaaattgtggcagaaaaagctttggaatatttagctcaacattcagaagaccaggaacaagttcttacagctgtaaagtgtttgcttcgttttcttcttccaaaaattgctgaaatgccggaatctgaagataagaagaaagaaatggatcgacttttgacttgcctgaatagagcctttgtgaaactttctcagccttttggtgaagaagccttaagtttggagtcaagagctaatgaagctcagtggtttcgaaaaacagcttggaacttggctgtgcaatgtgacaaagatccagtgatgatgagagagttttttatactttcttataagatgtcccagttttgtccttctgatcaagtaattctgattgcacggaaaacatgtttacttatggcagttgcagttgatctagagcaagggagaaaagcttcaacagcttttgaacagaccatgttcctgagtcgtgcacttgaggagatccagacatgcaatgacatccataatttcctgaaacaaacagggaccttctcaaatgattcatgtgagaaattgcttctgctgtacgagtttgaagttagagccaaattgaatgatccattactggaaagcttcctggaatcagtgtgggagttgcctcatttagaaactaaaacttttgaaacaattgcaataatagcaatggaaaagcctgcacactatcctttgattgctctcaaggccttgaaaaaggctttattgctctacaaaaaggaagaaccaattgatatatcacaatacagcaaatgtatgcacaacttggttaacctctcagtgccagatggggcgtcgaatgtagagctctgtcccctggaagaagtttggggctattttgaagatgctctgagccacattagccgcactaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaattt

SEQ ID NO: 190173 - DNA, 2224 bp, Homo sapiens
  Payload ID: 17552
  Gene Symbol: TEX11
  Gene Name: testis expressed 11
  Uniprot ID: Q8IYF3
  ENST ID: ENST00000374320
  CDS Start-End: 223-2070
agtatcacctcagcatacacagattgaaaaatgttagaaaccaggaagacaactctacttttttgcattgggggaataaacaaaccaactaaccaactaaaataatacacttactccaactaagacaacataggaagaccagagagatgattggagtcaccaagttgaagtacattagtttgggatgataattccttatgacagtgtttatccaaatctgtcatggaaatactacatcttgacatgcccttagacttctgtctgaacattgctaaactgctgatggatcatgaaagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttagctcaccaaacaggaagacaactgacagcagaatcaatgaactggttacacaacattctgtggagacaagctgccagtagttttgaggtacaaaattacactgatgccctacaatggtactattattctctgaggttttattcaactgatgaaatggatctggacttcaccaagctgcagaggaacatggcttgctgttacctgaatttgcaacaacttgataaggccaaagaggcagtggcagaagctgaacgacatgaccctaggaacgttttcactcaattttatatattcaagattgcagtcatagagggcaactctgaaagagctttgcaggcaataattactttagagaatatattaacagatgaagagtcagaagataatgatctagttgcagagagaggttcacctaccatgcttctaagtttagctgcccagtttgctctagagaatggacaacaaattgtggcagaaaaagctttggaatatttagctcaacattcagaagaccaggaacaagttcttacagctgtaaagtgtttgcttcgttttcttcttccaaaaattgctgaaatgccggaatctgaagataagaagaaagaaatggatcgacttttgacttgcctgaatagagcctttgtgaaactttctcagccttttggtgaagaagccttaagtttggagtcaagagctaatgaagctcagtggtttcgaaaaacagcttggaacttggctgtgcaatgtgacaaagatccagtgatgatgagagagttttttatactttcttataagatgtcccagttttgtccttctgatcaagtaattctgattgcacggaaaacatgtttacttatggcagttgcagttgatctagagcaagggagaaaagcttcaacagcttttgaacagaccatgttcctgagtcgtgcacttgaggagatccagacatgcaatgacatccataatttcctgaaacaaacagggaccttctcaaatgattcatgtgagaaattgcttctgctgtacgagtttgaagttagagccaaattgaatgatccattactggaaagcttcctggaatcagtgtgggagttgcctcatttagaaactaaaacttttgaaacaattgcaataatagcaatggaaaagcctgcacactatcctttgattgctctcaaggccttgaaaaaggctttattgctctacaaaaaggaagaaccaattgatatatcacaatacagcaaatgtatgcacaacttggttaacctctcagtgccagatggggcgtcgaatgtagagctctgtcccctggaagaagtttggggctattttgaagatgctctgagccacattagccgcactaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaattt

SEQ ID NO: 190174 - DNA, 3032 bp, Homo sapiens
  Payload ID: 17552
  Gene Symbol: TEX11
  Gene Name: testis expressed 11
  Uniprot ID: Q8IYF3
  ENST ID: ENST00000374333
  CDS Start-End: 100-2877
ggagttttctgaacgtcctcgtgcgctgtggacggaggttgtggagagagcagggcggcattggtggctgcggctgaggcttgagccagagatttaaaaatggacaatgatgattttttttccatggactttaaagaagttgttgaaaacctggttacaaatgataattcacctaacataccagaggcaattgatagactcttcagcgacatagcaaatatcaacagggagtctatggctgaaataacagacattcagattgaagaaatggcagtaaacctatggaactgggcacttaccataggaggaggttggcttgtaaatgaagagcagaaaattagattacattatgttgcttgcaagttgctgagtatgtgtgaagcctcatttgcctcagaacaaagtattcaacgactgattatgatgaatatgagaataggaaaagaatggttggatgctggaaattttctaatcgctgatgaatgttttcaagctgctgtggccagtctggagcaattatacgtcaaattaattcaaaggagctcccctgaggctgacttgaccatggagaagattactgttgagagtgaccacttcagagtgctttcttaccaagcagagtcagcagttgctcaaggggattttcaaagagcatctatgtgtgtactgcaatgtaaagatatgttgatgaggctcccccagatgacttcaagtcttcatcatctctgttacaactttggagtagaaacccagaagaataataaatatgaagaaagttctttctggcttagccaaagctatgatattgggaagatggataagaaatctactgggccagaaatgctggctaaagttctacggctattagccacgaattatttggattgggatgacaccaaatattatgataaggctctcaatgctgtaaacctagcaaacaaggaacatttaagttctcctgggcttttcttaaaaatgaaaatcctcttgaaaggcgaaacatctaatgaagaactccttgaagctgtcatggaaatactacatcttgacatgcccttagacttctgtctgaacattgctaaactgctgatggatcatgaaagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttagctcaccaaacaggaagacaactgacagcagaatcaatgaactggttacacaacattctgtggagacaagctgccagtagttttgaggtacaaaattacactgatgccctacaatggtactattattctctgaggttttattcaactgatgaaatggatctggacttcaccaagctgcagaggaacatggcttgctgttacctgaatttgcaacaacttgataaggccaaagaggcagtggcagaagctgaacgacatgaccctaggaacgttttcactcaattttatatattcaagattgcagtcatagagggcaactctgaaagagctttgcaggcaataattactttagagaatatattaacagatgaagagtcagaagataatgatctagttgcagagagaggttcacctaccatgcttctaagtttagctgcccagtttgctctagagaatggacaacaaattgtggcagaaaaagctttggaatatttagctcaacattcagaagaccaggaacaagttcttacagctgtaaagtgtttgcttcgttttcttcttccaaaaattgctgaaatgccggaatctgaagataagaagaaagaaatggatcgacttttgacttgcctgaatagagcctttgtgaaactttctcagccttttggtgaagaagccttaagtttggagtcaagagctaatgaagctcagtggtttcgaaaaacagcttggaacttggctgtgcaatgtgacaaagatccagtgatgatgagagagttttttatactttcttataagatgtcccagttttgtccttctgatcaagtaattctgattgcacggaaaacatgtttacttatggcagttgcagttgatctagagcaagggagaaaagcttcaacagcttttgaacagaccatgttcctgagtcgtgcacttgaggagatccagacatgcaatgacatccataatttcctgaaacaaacagggaccttctcaaatgattcatgtgagaaattgcttctgctgtacgagtttgaagttagagccaaattgaatgatccattactggaaagcttcctggaatcagtgtgggagttgcctcatttagaaactaaaacttttgaaacaattgcaataatagcaatggaaaagcctgcacactatcctttgattgctctcaaggccttgaaaaaggctttattgctctacaaaaaggaagaaccaattgatatatcacaatacagcaaatgtatgcacaacttggttaacctctcagtgccagatggggcgtcgaatgtagagctctgtcccctggaagaagtttggggctattttgaagatgctctgagccacattagccgcactaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaattta

SEQ ID NO: 190175 - DNA, 3133 bp, Homo sapiens
  Payload ID: 17552
  Gene Symbol: TEX11
  Gene Name: testis expressed 11
  Uniprot ID: Q8IYF3
  ENST ID: ENST00000395889
  CDS Start-End: 157-2979
gtgcgctgtggacggaggttgtggagagagcagggcggcattggtggctgcggctgaggcttgagccagagatttaaaaatggacaatgatgattttttttccatggactttaaagatggagtctgtctctgttgtccaggctggagtgcagtggcatgatctcggctcactgcaacctccgcctcctgtgttcaagcgattcttctgcctcagcctcccaagtagctgggactacagaagttgttgaaaacctggttacaaatgataattcacctaacataccagaggcaattgatagactcttcagcgacatagcaaatatcaacagggagtctatggctgaaataacagacattcagattgaagaaatggcagtaaacctatggaactgggcacttaccataggaggaggttggcttgtaaatgaagagcagaaaattagattacattatgttgcttgcaagttgctgagtatgtgtgaagcctcatttgcctcagaacaaagtattcaacgactgattatgatgaatatgagaataggaaaagaatggttggatgctggaaattttctaatcgctgatgaatgttttcaagctgctgtggccagtctggagcaattatacgtcaaattaattcaaaggagctcccctgaggctgacttgaccatggagaagattactgttgagagtgaccacttcagagtgctttcttaccaagcagagtcagcagttgctcaaggggattttcaaagagcatctatgtgtgtactgcaatgtaaagatatgttgatgaggctcccccagatgacttcaagtcttcatcatctctgttacaactttggagtagaaacccagaagaataataaatatgaagaaagttctttctggcttagccaaagctatgatattgggaagatggataagaaatctactgggccagaaatgctggctaaagttctacggctattagccacgaattatttggattgggatgacaccaaatattatgataaggctctcaatgctgtaaacctagcaaacaaggaacatttaagttctcctgggcttttcttaaaaatgaaaatcctcttgaaaggcgaaacatctaatgaagaactccttgaagctgtcatggaaatactacatcttgacatgcccttagacttctgtctgaacattgctaaactgctgatggatcatgaaagagaatctgttgggtttcatttcctgacgattattcatgaacgttttaagtcatcggaaaatattggaaaagttctgatactccatactgacatgcttttacaaaggaaggaagaacttcttgccaaggagaagattgaagaaatctttttagctcaccaaacaggaagacaactgacagcagaatcaatgaactggttacacaacattctgtggagacaagctgccagtagttttgaggtacaaaattacactgatgccctacaatggtactattattctctgaggttttattcaactgatgaaatggatctggacttcaccaagctgcagaggaacatggcttgctgttacctgaatttgcaacaacttgataaggccaaagaggcagtggcagaagctgaacgacatgaccctaggaacgttttcactcaattttatatattcaagattgcagtcatagagggcaactctgaaagagctttgcaggcaataattactttagagaatatattaacagatgaagagtcagaagataatgatctagttgcagagagaggttcacctaccatgcttctaagtttagctgcccagtttgctctagagaatggacaacaaattgtggcagaaaaagctttggaatatttagctcaacattcagaagaccaggaacaagttcttacagctgtaaagtgtttgcttcgttttcttcttccaaaaattgctgaaatgccggaatctgaagataagaagaaagaaatggatcgacttttgacttgcctgaatagagcctttgtgaaactttctcagccttttggtgaagaagccttaagtttggagtcaagagctaatgaagctcagtggtttcgaaaaacagcttggaacttggctgtgcaatgtgacaaagatccagtgatgatgagagagttttttatactttcttataagatgtcccagttttgtccttctgatcaagtaattctgattgcacggaaaacatgtttacttatggcagttgcagttgatctagagcaagggagaaaagcttcaacagcttttgaacagaccatgttcctgagtcgtgcacttgaggagatccagacatgcaatgacatccataatttcctgaaacaaacagggaccttctcaaatgattcatgtgagaaattgcttctgctgtacgagtttgaagttagagccaaattgaatgatccattactggaaagcttcctggaatcagtgtgggagttgcctcatttagaaactaaaacttttgaaacaattgcaataatagcaatggaaaagcctgcacactatcctttgattgctctcaaggccttgaaaaaggctttattgctctacaaaaaggaagaaccaattgatatatcacaatacagcaaatgtatgcacaacttggttaacctctcagtgccagatggggcgtcgaatgtagagctctgtcccctggaagaagtttggggctattttgaagatgctctgagccacattagccgcactaaagactacccagaaatggagattctctggctgatggtcaagtcctggaataccggagtacttatgtttagcaggagcaagtatgcatctgctgaaaagtggtgtggcctggccttgcgtttccttaaccaccttacctccttcaaggaaagctatgaaactcagatgaatatgctgtatagtcagcttgtggaagcattgagtaacaacaagggcccagtttttcatgaacatggctactggagcaagtcagattaggcaagctcatggccacatgaagaagatacattgtcccgagatgctgactgtttaaatttttgccagagtttctcttgagcttttgtttctgtttgctcagaccctgttttcatgttgttgaataaactttctaaaataaaagcatgctgaattt

SEQ ID NO: 190176 - DNA, 1147 bp, Homo sapiens
  Payload ID: 17553
  Gene Symbol: TEX12
  Gene Name: testis expressed 12
  Uniprot ID: Q9BXU0
  ENST ID: ENST00000280358
  CDS Start-End: 133-504
actccctcgcgttcgctgacgaggaaggtccccataccgcgaagtacattggccttggggtggggctggagggatgggcgcctgtgagaatgtgacggactgtgacacaaggaaggctggtgccttcggaatatgatggcaaatcaccttgtaaagcctgataatagaaattgcaagaggccaagagaattggagtctccagtgccagatagtccacagctgtcctctcttggaaaatcagattcatctttctctgaaatttccggactattttataaagatgaagccttggagaaagatttaaatgatgtgagcaaggaaattaatctaatgttgtctacctatgcaaagcttttaagtgagagagcagcagtagatgcatcttacattgatgagatagatgaactcttcaaagaagccaatgctattgaaaactttctaatacaaaaaagagagttcctgcgacagaggtttacagtgattgcaaacacattacacagataaaatatatacttgaaataagctgagaatttaaacctattattgttataatgaaagaatgacatttatgctttgaaagctctcgagttgttaaagaaaatgtatatctcgaatagagaaggggaaactccttgaatttctaggtttaaaaaggaacttttaaattccttaatgttaatattaatgttcatgttaatgtcctaagctggccattaacatgaactacgtcacttttcttttgagggtcaaatatttagtgcattttatagaagtgtaaattatttaaatcttatgtggattcttttattttttccttaaacttcttagtgtttctgaaacttctaaaaaaggattcagttaatttataatgtttaataatattatacttttagaatattttgtttaaatatcagatagttttggagataattttgaaattttttttatggtcaggattataaaagaagattaaaaccttagaggtgatttttccagtttcttagaatataatgacataactgtgtgctatttccatttgattattttcactattagttattatgtatgactaataaaagctctcggcttaaaattattttcttgtggtaaaagtagtaaaataaaaaccagaaattactcaccagaa

SEQ ID NO: 190177 - DNA, 787 bp, Homo sapiens
  Payload ID: 17553
  Gene Symbol: TEX12
  Gene Name: testis expressed 12
  Uniprot ID: Q9BXU0
  ENST ID: ENST00000530752
  CDS Start-End: 68-439
actccctcgcgttcgctgacgaggaaggtccccataccgcgaactttgtagctggtgccttcggaatatgatggcaaatcaccttgtaaagcctgataatagaaattgcaagaggccaagagaattggagtctccagtgccagatagtccacagctgtcctctcttggaaaatcagattcatctttctctgaaatttccggactattttataaagatgaagccttggagaaagatttaaatgatgtgagcaaggaaattaatctaatgttgtctacctatgcaaagcttttaagtgagagagcagcagtagatgcatcttacattgatgagatagatgaactcttcaaagaagccaatgctattgaaaactttctaatacaaaaaagagagttcctgcgacagaggtttacagtgattgcaaacacattacacagataaaatatatacttgaaataagctgagaatttaaacctattattgttataatgaaagaatgacatttatgctttgaaagctctcgagttgttaaagaaaatgtatatctcgaatagagaaggggaaactccttgaatttctaggtttaaaaaggaacttttaaattccttaatgttaatattaatgttcatgttaatgtcctaagctggccattaacatgaactacgtcacttttcttttgagggtcaaatatttagtgcattttatagaagtgtaaattatttaaatcttatgtggattcttttattttttccttaaacttcttagtgtttctgaaacttctaaaaaagg

SEQ ID NO: 190178 - DNA, 1377 bp, Homo sapiens
  Payload ID: 17554
  Gene Symbol: TEX13A
  Gene Name: testis expressed 13A
  Uniprot ID: Q9BXU3
  ENST ID: ENST00000600991
  CDS Start-End: 113-1342
gggagagagatcttcctctctcttcgggcgtgttaagacagcggggttggcctgtacttcctctggccctggctgaagagggctagtgaaaccgttaaacccctaggcgatcatggccttgagacctgaggaccccagtagcgggttccggcatagcaacgtggtggccttcatcaacgagaaaatggccaggcacacgaaaggccccgagttctatcttgagaatatatccttatcctgggagaaggtggaagacaagctgagggccatactggaggacagcgaggtgcccagtgaggtcaaagaggcctgcacctggggcagcctggccttgggagtgcgctttgcccacaggcaggcacagctacaaaggcacagggtgcggtggctgcacggcttcgccaaactgcacaaatcagccgcacaggccttggcatcagacctgaagaagctcagggagcagcaggagacggaacgcaaggaggcggcctcccggctaagaatggcccagaccagcctcgtggaggtgcagaaagagagagacaaggagctggtgtctccccatgagtgggagcagggggcagggtggccaggcctggccactgccggaggggtttgcacagaaggagcagctgaggaggaagaagaggcggcggtggctgctgctggtgctgctggaggaaaaggagcagaagaagagcagagggatgtggaggttgtggctgcccctgtggaggccatggctccccctgtggaggctggggctgcccccatggagacccagttcccccacgtggaggccagggctgcctccatggagaccacagagaagctggagagaatcctcctgcagctccttggagatgctgatcaggaaaagtacacctattgggggcagaaggagggagatctccggtcggtcgaaacagccacatcttatttctctggaaccacgaacccctggtccagagcctcatcagaacctcttcctgtccagctccctgcctcatactcatactcatactcaagccctttttcctccttctcagacatacccactatatcccctccacaagcaacagtcacagcaccagttccgcctcagctgccttccgactgggaggcctttgatactagcctgtggtctgatggggggccccacagaatagaccatcaggagcacccaagagacaggagatactccgaacctcatcagcaaagacctccagtatatcgcaggccaggggactgggactgcccttggtgtaacgctgtgaatttttcacggagggatacttgcttcgactgtgggaagggaatctggctgcaaaaacctcattgagtgcagaaatgcaaaatagaaccgaagcatgtata

SEQ ID NO: 190179 - DNA, 1349 bp, Homo sapiens
  Payload ID: 17554
  Gene Symbol: TEX13A
  Gene Name: testis expressed 13A
  Uniprot ID: Q9BXU3
  ENST ID: ENST00000609007
  CDS Start-End: 87-1316
gggagagagatcttcctctctcttcgggcgtgttaagacagcggggttggcctgtacttcctctggccctggctgaagaggcgatcatggccttgagacctgaggaccccagtagcgggttccggcatagcaacgtggtggccttcatcaacgagaaaatggccaggcacacgaaaggccccgagttctatcttgagaatatatccttatcctgggagaaggtggaagacaagctgagggccatactggaggacagcgaggtgcccagtgaggtcaaagaggcctgcacctggggcagcctggccttgggagtgcgctttgcccacaggcaggcacagctacaaaggcacagggtgcggtggctgcacggcttcgccaaactgcacaaatcagccgcacaggccttggcatcagacctgaagaagctcagggagcagcaggagacggaacgcaaggaggcggcctcccggctaagaatggcccagaccagcctcgtggaggtgcagaaagagagagacaaggagctggtgtctccccatgagtgggagcagggggcagggtggccaggcctggccactgccggaggggtttgcacagaaggagcagctgaggaggaagaagaggcggcggtggctgctgctggtgctgctggaggaaaaggagcagaagaagagcagagggatgtggaggttgtggctgcccctgtggaggccatggctccccctgtggaggctggggctgcccccatggagacccagttcccccacgtggaggccagggctgcctccatggagaccacagagaagctggagagaatcctcctgcagctccttggagatgctgatcaggaaaagtacacctattgggggcagaaggagggagatctccggtcggtcgaaacagccacatcttatttctctggaaccacgaacccctggtccagagcctcatcagaacctcttcctgtccagctccctgcctcatactcatactcatactcaagccctttttcctccttctcagacatacccactatatcccctccacaagcaacagtcacagcaccagttccgcctcagctgccttccgactgggaggcctttgatactagcctgtggtctgatggggggccccacagaatagaccatcaggagcacccaagagacaggagatactccgaacctcatcagcaaagacctccagtatatcgcaggccaggggactgggactgcccttggtgtaacgctgtgaatttttcacggagggatacttgcttcgactgtgggaagggaatctggctgcaaaaacctcattgagtgcagaaatgcaaaatagaaccgaagcatgta

SEQ ID NO: 190180 - DNA, 1248 bp, Homo sapiens
  Payload ID: 17555
  Gene Symbol: TEX13B
  Gene Name: testis expressed 13B
  Uniprot ID: Q9BXU2
  ENST ID: ENST00000302917
  CDS Start-End: 94-1032
tctcttcaggcgtgttaagcagcggggttggcctgtacttcctctggccctggctgaagagggctagtgaaaccgttaagcccctaggcgatcatggccttgagacctgaggaccccagtagtgggttccggcacggaaacgtggtggccttcatcatcgagaaaatggccaggcacacgaaaggccccgagttctacttcgagaatatatccttatcctgggaggaggtggaagacaagctcagggccatcctggaggacagcgaggtgcccagcgaggtcaaagaggcctgcacctggggcagcctggccttgggtgtgcgctttgcccacaggcaggggcagttacaaaaccgcagggtgcagtggctgcaaggctttgccaaactgcacagatcagctgcgctggtcttggcctcaaacctgacggaactcaaggaacagcaggagatggaatgcaatgaggcgaccttccagttgcagctaaccgagaccagccttgcggaggtgcagagagagcgggacatgctgagatggaagctcttccatgccgagctggcacctccccagggacagggccaggctacagtgtttccaggcctggccactgccggaggggattggacagaaggagcaggtgagcaggaaaaggaggcggtggctgctgctggtgctgctggaggaaaaggagaggagaggtatgcagaggcagggcctgcccccgcagaggtcttgcaggggctgggaggaggcttcaggcagcccctcggagctattgtagcaggcaaattacacctttgcggggcagagggagaaagatctcaggtcagtacaaacagccatgtctgtcttctctgggcttgggtccacagtctcactggagcctcttcctgtccagctccctacctcattcacatactcatacccatgccctttgtccgccttctcagccatacccaatatacccccttcaccagcaaaggtcacagaacgggttccaactcagatgcctttcaactggggggcctctgatgctagcctgtggtcagatgtggaggcccagggaatagaccctcaagagcccccaagagacaggagagactccgaactccatcagcagagaagacctccagtatatcgcaggccagggaactgggactgcccgtggtgtaaagctgtgaatttttcatggagggaaaattgcttcctctgtgggaggcgaatctggctgcaaaagcctcagtaaat

SEQ ID NO: 190181 - DNA, 4911 bp, Homo sapiens
  Payload ID: 17556
  Gene Symbol: TEX14
  Gene Name: testis expressed 14
  Uniprot ID: Q8IWB6
  ENST ID: ENST00000240361
  CDS Start-End: 87-4580
ttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaaggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagaagatagactccccgcagcggcttgtctacagcccgtcctggtgtgggggcctcgtgcagggaaaccctaatggctctcctaaccgactgcttaaagctggagtcatttctgctcaaaatatctacagctttggttttgggaaggctatgccttggtttcagttttatcttactggggcgacacagatggcctatctaggatctcttccggtcattggagaaaaggaagtgattcaagctgatgatgagcccaccttctctttcttcagcggcccctacatggtcatgaccaacctagtgtggaatgggagcagggtcacagtgaaagagctgaatctccccacccacccacactgcagcaggctgcggctggccgacttgttaattgccgagcaggaacacagcagcaagctgcggcacccctacttgctacagttgatggctgtgtgtctctcccaggacctagagaaaacccgccttgtgtacgagcgcatcactatcggcacattgttcagtgtccttcatgaacgacggtcccagttcccagtgctgcacatggaggtgattgtgcacctgctgctccagatatctgatgccctgagatacctgcatttccaggggtttatccaccgctccctcagctcctatgctgtccatatcatctccccaggtgaagcgaggctgaccaacctggagtacatgttggaaagcgaggacagaggtgtacagagggacctgactcgagtgccccttcctacgcagctatacaactgggccgcaccagaagtgatcttacagaaggcagccacagtgaaatcagacatctacagcttttctatgatcatgcaggagattttaacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatgctgccgactctttgtgaccctggaaaacagaacacagatgaacaatttcagtgcactcaaggagccaaggacagtttggaaacaagcaggatccaaaataccagtagccagggaagacctagagagtccactgcccaagccaaagccacacagtttaatagtgcactcttcactctgtcaagccaccggcagggaccttctgcatcacccagctgtcactgggactctaccaggatgagtgtggaacctgtttcttctgaaatctataatgcagagtccagaaataaagatgatggaaaggtacacttaaaatggaaaatggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtatcaggcacccatctcccagacaaaaggagcaaccagagcatagtgaagccttccaagcaagttctgacacattggtggctgtagagaaatcttacagtcatcagtccatgcaatcaacttgttcaccagagtcttctgaggatataacagatgaatttttaactccagacggtgaatatttttactcctcgactgctcaagaaaacttagctctagagacctcgagtcccatagaagaggactttgaaggaatacaaggtgcatttgcccaacctcaagtctctggtgaggaaaagttccaaatgagaaaaattcttggaaagaatgctgagattttgcccaggtctcaatttcaacctgtacgaagtactgaagatgaacaagaagagacatcaaaggagtcaccaaaggaactgaaagagaaagacatatcattgacggatattcaagacctgtctagtatctcctatgaaccagacagctcttttaaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgagctcttgaaacagcagcagggctcatccacggtgttgcatgagaacacagcaagtgatggaggaggcactgcaaatgatcaaaggcacttagaagaacaagaaactgacagtaaaaaagaagatagtagtatgcttttgtccaaagaaactgaagatcttggagaggacacagagagagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagaaagaaggaaatcagagggtgttctagggacttctgaagaagatgaactaaaatcctgtttttggaagcgactaggttggtccgaatcatccaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataaca

SEQ ID NO: 190182 - DNA, 4773 bp, Homo sapiens
  Payload ID: 17556
  Gene Symbol: TEX14
  Gene Name: testis expressed 14
  Uniprot ID: Q8IWB6
  ENST ID: ENST00000349033
  CDS Start-End: 87-4442
ttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaaggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagaagatagactccccgcagcggcttgtctacagcccgtcctggtgtgggggcctcgtgcagggaaaccctaatggctctcctaaccgactgcttaaagctggagtcatttctgctcaaaatatctacagctttggttttgggaagttttatcttactggggcgacacagatggcctatctaggatctcttccggtcattggagaaaaggaagtgattcaagctgatgatgagcccaccttctctttcttcagcggcccctacatggtcatgaccaacctagtgtggaatgggagcagggtcacagtgaaagagctgaatctccccacccacccacactgcagcaggctgcggctggccgacttgttaattgccgagcaggaacacagcagcaagctgcggcacccctacttgctacagttgatggctgtgtgtctctcccaggacctagagaaaacccgccttgtgtacgagcgcatcactatcggcacattgttcagtgtccttcatgaacgacggtcccagttcccagtgctgcacatggaggtgattgtgcacctgctgctccagatatctgatgccctgagatacctgcatttccaggggtttatccaccgctccctcagctcctatgctgtccatatcatctccccaggtgaagcgaggctgaccaacctggagtacatgttggaaagcgaggacagaggtgtacagagggacctgactcgagtgccccttcctacgcagctatacaactgggccgcaccagaagtgatcttacagaaggcagccacagtgaaatcagacatctacagcttttctatgatcatgcaggagattttaacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatgctgccgactctttgtgaccctggaaaacagaacacagatgaacaatttcagtgcactcaaggagccaaggacagtttggaaacaagcaggatccaaaataccagtagccagggaagacctagagagtccactgcccaagccaaagccacacagtttaatagtgcactcttcactctgtcaagccaccggcagggaccttctgcatcacccagctgtcactgggactctaccaggatgagtgtggaacctgtttcttctgaaatctataatgcagagtccagaaataaagatgatggaaaggtacacttaaaatggaaaatggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtatcaggcacccatctcccagacaaaaggagcaaccagagcatagtgaagccttccaagcaagttctgacacattggtggctgtagagaaatcttacagtacctcgagtcccatagaagaggactttgaaggaatacaaggtgcatttgcccaacctcaagtctctggtgaggaaaagttccaaatgagaaaaattcttggaaagaatgctgagattttgcccaggtctcaatttcaacctgtacgaagtactgaagatgaacaagaagagacatcaaaggagtcaccaaaggaactgaaagagaaagacatatcattgacggatattcaagacctgtctagtatctcctatgaaccagacagctcttttaaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgagctcttgaaacagcagcagggctcatccacggtgttgcatgagaacacagcaagtgatggaggaggcactgcaaatgatcaaaggcacttagaagaacaagaaactgacagtaaaaaagaagatagtagtatgcttttgtccaaagaaactgaagatcttggagaggacacagagagagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagaaagaaggaaatcagagggtgttctagggacttctgaagaagatgaactaaaatcctgtttttggaagcgactaggttggtccgaatcatccaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataaca

SEQ ID NO: 190183 - DNA, 4927 bp, Homo sapiens
  Payload ID: 17556
  Gene Symbol: TEX14
  Gene Name: testis expressed 14
  Uniprot ID: Q8IWB6
  ENST ID: ENST00000389934
  CDS Start-End: 119-4594
atcagtccgcattccccgcacccacccacgtcttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaaggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagaagatagactccccgcagcggcttgtctacagcccgtcctggtgtgggggcctcgtgcagggaaaccctaatggctctcctaaccgactgcttaaagctggagtcatttctgctcaaaatatctacagctttggttttgggaagttttatcttactggggcgacacagatggcctatctaggatctcttccggtcattggagaaaaggaagtgattcaagctgatgatgagcccaccttctctttcttcagcggcccctacatggtcatgaccaacctagtgtggaatgggagcagggtcacagtgaaagagctgaatctccccacccacccacactgcagcaggctgcggctggccgacttgttaattgccgagcaggaacacagcagcaagctgcggcacccctacttgctacagttgatggctgtgtgtctctcccaggacctagagaaaacccgccttgtgtacgagcgcatcactatcggcacattgttcagtgtccttcatgaacgacggtcccagttcccagtgctgcacatggaggtgattgtgcacctgctgctccagatatctgatgccctgagatacctgcatttccaggggtttatccaccgctccctcagctcctatgctgtccatatcatctccccaggtgaagcgaggctgaccaacctggagtacatgttggaaagcgaggacagaggtgtacagagggacctgactcgagtgccccttcctacgcagctatacaactgggccgcaccagaagtgatcttacagaaggcagccacagtgaaatcagacatctacagcttttctatgatcatgcaggagattttaacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatgctgccgactctttgtgaccctggaaaacagaacacagatgaacaatttcagtgcactcaaggagccaaggacagtttggaaacaagcaggatccaaaataccagtagccagggaagacctagagagtccactgcccaagccaaagccacacagtttaatagtgcactcttcactctgtcaagccaccggcagggaccttctgcatcacccagctgtcactgggactctaccaggatgagtgtggaacctgtttcttctgaaatctataatgcagagtccagaaataaagatgatggaaaggtacacttaaaatggaaaatggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtatcaggcacccatctcccagacaaaaggagcaaccagagcatagtgaagccttccaagcaagttctgacacattggtggctgtagagaaatcttacagtcatcagtccatgcaatcaacttgttcaccagagtcttctgaggatataacagatgaatttttaactccagacggtgaatatttttactcctcgactgctcaagaaaacttagctctagagacctcgagtcccatagaagaggactttgaaggaatacaaggtgcatttgcccaacctcaagtctctggtgaggaaaagttccaaatgagaaaaattcttggaaagaatgctgagattttgcccaggtctcaatttcaacctgtacgaagtactgaagatgaacaagaagagacatcaaaggagtcaccaaaggaactgaaagagaaagacatatcattgacggatattcaagacctgtctagtatctcctatgaaccagacagctcttttaaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgagctcttgaaacagcagcagggctcatccacggtgttgcatgagaacacagcaagtgatggaggaggcactgcaaatgatcaaaggcacttagaagaacaagaaactgacagtaaaaaagaagatagtagtatgcttttgtccaaagaaactgaagatcttggagaggacacagagagagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagaaagaaggaaatcagagggtgttctagggacttctgaagaagatgaactaaaatcctgtttttggaagcgactaggttggtccgaatcatccaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataacaga

SEQ ID NO: 190184 - DNA, 676 bp, Homo sapiens
  Payload ID: 17556
  Gene Symbol: TEX14
  Gene Name: testis expressed 14
  ENST ID: ENST00000581147
  CDS Start-End: 1-457
taaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgttgctgtgtaaaccttccattcacctcctccatttcagcagctgtgttaccagactttgtcctgggctctggccttatggtgctgctgcaccccagcacagtctgcagaagccttccctcatttcacttatgggaattatctggaccaggtttctagagctcttgaaacagcagcagggctcatccacggtgttgcatgagaacacagcaagtgatggaggaggcactgc

SEQ ID NO: 190185 - DNA, 4834 bp, Homo sapiens
  Payload ID: 17556
  Gene Symbol: TEX14
  Gene Name: testis expressed 14
  ENST ID: ENST00000582740
  CDS Start-End: 109-309
attccccgcacccacccacgtcttcccgggagtcgtatcccgagcatggaggttactgagaccgttatttcttcatggcctgcctagcttaagcagtagctggaaaagatgtctcgggctgttcgtcttccagtcccctgtcctgttcaacttggtaccttaagaaatgactccctggaagctcagcttcatgagtatgtcaaacaagggaactatgtgaaagtgaagaaaattcttaagaaagctctggagttgccacaaacagcgttgagatcagaggaagagtggagaagcaaggaggagaattaacagagcattgctgcatcctgcagtgcggaggagggaagaaattggaatcggcctgggaatttatgttgatgcagttaactccttgggccaaacagcactttttgttgcggcgttattgggccttaggaaattcgttgatgttctggtggattatggatcagatccaaatcaccgctgctttgatgggagcacccctgtccatgcagcagcattttcgggcaatcagtggatccttagcaaactgctggatgcaggaggtgacctgcgactccacgatgagaggggtcaaaacccgaagacttgggctttgacagcaggaaaggagcgtagcacccagatagtggagttcatgcagcgctgtgcctcacacatgcaggccatcatccagggcttctcttacgacctcctgaagaagatagactccccgcagcggcttgtctacagcccgtcctggtgtgggggcctcgtgcagggttttatcttactggggcgacacagatggcctatctaggatctcttccggtcattggagaaaaggaagtgattcaagctgatgatgagcccaccttctctttcttcagcggcccctacatggtcatgaccaacctagtgtggaatgggagcagggtcacagtgaaagagctgaatctccccacccacccacactgcagcaggctgcggctggccgacttgttaattgccgagcaggaacacagcagcaagctgcggcacccctacttgctacagttgatggctgtgtgtctctcccaggacctagagaaaacccgccttgtgtacgagcgcatcactatcggcacattgttcagtgtccttcatgaacgacggtcccagttcccagtgctgcacatggaggtgattgtgcacctgctgctccagatatctgatgccctgagatacctgcatttccaggggtttatccaccgctccctcagctcctatgctgtccatatcatctccccaggtgaagcgaggctgaccaacctggagtacatgttggaaagcgaggacagaggtgtacagagggacctgactcgagtgccccttcctacgcagctatacaactgggccgcaccagaagtgatcttacagaaggcagccacagtgaaatcagacatctacagcttttctatgatcatgcaggagattttaacagatgacataccctggaagggcttagatggctcagttgttaaaaaagccgtagtctcggggaattatttagaagctgatgtcaggcttccgaaaccttactatgatattgttaagtcaggcatccacgtcaagcagaaagaccgaactatgaaccttcaagatatccggtatattctgaagaatgacttaaaggattttactggagcccagagaactcaaccaaccgagagccccagagtgcagagatacggactccatcccgatgtcaatgtctatctaggactgacttcagaacaccccagagagacacctgacatggaaatcatagaactaaaggaaatgggcagtcaacctcattcaccaagggttcactctttattcactgaggggacactagatcctcaggccccagatccatgtctgatggccagggagactcagaatcaagatgctccttgccctgctccatttatggcagaagaggccagcagccccagcacaggtcagccaagcctctgcagtttcgaaatcaacgagatctactcaggctgcttgattttggaagatgacatagaagagcctccaggagctgcttcatctttggaggcagacggacctaaccaggtagatgaactgaaatccatggaagaagagctggataagatggagagagaggcgtgttgttttggcagtgaggatgagagctcttcaaaagctgagacagagtactcttttgatgactgggactggcaaaacggttcactcagttcactcagccttcctgagtcaaccagagaagccaagagcaatttgaacaacatgtccacgactgaggagtatctcatcagtaagtgtgtgctggatctaaagattatgcagacaataatgcacgagaatgatgataggctgaggaatatcgagcagatattagatgaagtcgagatgaaacagaaggaacaggaagagcgcatgtctttatgggccacttcaagagagtttacaaatgcctacaagttacctctggccgtgggccctccatctttaaactatattcctcctgtcctacagctttcagggggtcagaagccagacaccagtggcaactacccaaccctaccaagatttccaagaatgctgccgactctttgtgaccctggaaaacagaacacagatgaacaatttcagtgcactcaaggagccaaggacagtttggaaacaagcaggatccaaaataccagtagccagggaagacctagagagtccactgcccaagccaaagccacacagtttaatagtgcactcttcactctgtcaagccaccggcagggaccttctgcatcacccagctgtcactgggactctaccaggatgagtgtggaacctgtttcttctgaaatctataatgcagagtccagaaataaagatgatggaaaggtacacttaaaatggaaaatggaggtgaaagaaatggcaaagaaagcagctactggacagctcacagtacctccttggcatcctcagagtagtctgactttagagagcgaggctgaaaatgagcccgacgccctgctgcagccccccattaggagcccagaaaacacggattggcagcgagttattgagtatcatagggaaaatgatgagcccagaggaaatggcaagtttgacaagacgggcaacaatgactgtgacagtgaccagcatggcagacagcccaggcttggaagcttcaccagtatcaggcacccatctcccagacaaaaggagcaaccagagcatagtgaagccttccaagcaagttctgacacattggtggctgtagagaaatcttacagtacctcgagtcccatagaagaggactttgaaggaatacaaggtgcatttgcccaacctcaagtctctggtgaggaaaagttccaaatgagaaaaattcttggaaagaatgctgagattttgcccaggtctcaatttcaacctgtacgaagtactgaagatgaacaagaagagacatcaaaggagtcaccaaaggaactgaaagagaaagacatatcattgacggatattcaagacctgtctagtatctcctatgaaccagacagctcttttaaggaagcttcatgcaaaacacccaaaataaaccatgcacctaccagtgtcagcactccactcagcccagggtccgtttcttcagctgccagtcagtataaagactgccttgaaagtatcacatttcaggttaagacagagtttgcctcttgctggaacagtcaagaatttattcaaactttgtctgatgactttataagtgtccgagagagagcaaagaaactggattctctccttacttcctctgaaactcccccttcaagactgactggtcttaaaagattgtcttcatttattggggctggatcccccagccttgttaaggcatgtgactcatcaccaccccatgccacccagagaaggagcctgcctaaagtagaagccttctcacagcatcacattgatgagctgccaccaccatctcaggagctacttgatgacattgagctcttgaaacagcagcagggctcatccacggtgttgcatgagaacacagcaagtgatggaggaggcactgcaaatgatcaaaggcacttagaagaacaagaaactgacagtaaaaaagaagatagtagtatgcttttgtccaaagaaactgaagatcttggagaggacacagagagagctcactctactctggatgaggacctggaaagatggctgcagccacctgaggagagcgtggagctacaagaccttcccaagggctctgaaagggagacaaatatcaaagatcaaaaagttggtgaagagaaaagaaaaagggaagatagcattacaccagaaagaaggaaatcagagggtgttctagggacttctgaagaagatgaactaaaatcctgtttttggaagcgactaggttggtccgaatcatccaggataatcgtgctggatcagagtgacttgtcagactgattggaattggatcatagacggactcctggcctgagtttgagtgtcctggttgtaagctcctttcttctctttctgcttcagttgctgtcagggcagcagttccagttctgtaagtctcactttgttcagctgccacaatagacatcatcgtttggccctctctgttagcagcacattcaaccatttgttttcagtcagatttctgaaaagtgagaggtagttttgatagtaaaaatttttggttgtgcctagaatggctttggttttgttgatgttaattttcaaaaactttaactcttgttatataataaaatgtttaattttaataaca

SEQ ID NO: 190186 - DNA, 10187 bp, Homo sapiens
  Payload ID: 17557
  Gene Symbol: TEX15
  Gene Name: testis expressed 15
  Uniprot ID: Q9BXT5
  ENST ID: ENST00000256246
  CDS Start-End: 76-8445
ggacagacagagcacagtttagcagaaattagagacacttctcaagtacttgcacatgattcagacatttcacttatgcccagtgatgccaaagacagtgttaatggtgaccttttgttaaattggacaagtcttaaaaatattttaagtggtcttaatgcttcttttcctcttcacaacaatactggctcaagcacagtcactacttcaaaatccatcaaagacccaagactgatgaggagagaagaaagtatgggagaacagagtagtactgcaggcttaaatgaggttttgcaatttgagaagagttcagataatgttaattcagaaataaaatcgacaccatctaattctgcctcctcctcagaagttgtccctggtgattgtgctgttcttactaatggtttggataccccttgctttaaaacttctgttaatgattcacaatcttgggctcacaacatgggctctgaggactatgactgtatacctcccaataaagttaccatggcagggcaatgtaaggaccaaggtaatttttccttcccaatttctgtgtcaaatgtagtgtcagaggttgagaaccaaaaccacagtgaggagaaggctcagagagcccaacaggagtccggtaatgcttatacaaaagagtacagtagtcacatttttcaggactcgcagtcttctgatttaaaaacaatttatcagactggttgccaaacgtctacagtttttccactcaaaaagaaagtaagcattgatgaataccttcaaaatactggaaagatgaaaaacttcgctgacctggaagacagttccaaacatgaagaaaagcaaacttcatggaaagaaattgataatgatttcactaatgaaacaaaaatcagtccaatagataattacattgttttgcaccaagaatacaaagagagtgagagtcataattcttttgggaaaagctgtgataaaatattaattactcaagagttagaaataacaaaatcttctacatctaccataaaggataaggatgaactagatcatctagcattggaatggcaaattactccaagttttgagagcctgtcacaaaagcatcctcagcactctgtggagtatgagggtaacattcatacaagtttagccattgctcaaaagctaatggaactgaaattggggaaaataaatcaaaattatgctagcattataactgaagctttcccgaaaccaaaagacataccccaggccaaagaaatgttcattgatacagttatttcatcttataacatagaaacagctcatgacagttcaaattgcagcataactagagaacatatatgtgtccataggaaaaatgaaaatgaaccagtgtcattagagaacattcagagagactataaagaaactgcttatgttgaagataggggtcaggatcacaatctgttctgtaattcacagttaagcaatgatatatggctgaatgttaatttcaaaaaacaaacagatagagaaaaccaaaatgaggctaaagagaatagtgcttcatgtgtagaaaacaacatagagaacatatatggagacaaaaagcaggattctcatacaaacgaaaatttcagcaatatagatgaaaaggaggacaaaaattaccacaatatagaaattttgagttctgaagaattttctactaaatttaacttgatttgcagagaagataatgcagtgtcagcagcaactgcattattagagagtgaagaagataccattagtgccgtgaaacaaaaagatactgaaaatactggaagaagtgtagagcatttggcttccacgacatttcccaaaactgcaagttcttcagtgtgtgtagcctcaaatgctgcaatacagatagctagtgctactatgcctgcattaagcctaaataatgacgatcaccagatataccagtttaaagaaacttgttcttctgaaagtccagattttggtttgttagtaaaacatagggtttctgattgtgaaattgatacggataaaaataaatcacaagaatcatttcatcaatcaataaatgagaacttagttcttcagagcattgaattggaaagtgaaattgaaatagaattagaagattgtgatgatgcttttatatttcaacaagatacacatagccatgaaaacatgctttgtgaagaatttgtgacctcatataaggctctgaagtctcgtatcagttgggaaggtctgttagcacttgataacggggagatggaagttttggaaagcaccacaggaagggagaatagtgatcagcattattctaaggaaagtaactatttttattcctctacacaaaacaatgaaacagaacttaccagcccaattttacttccagatctacaaattaaaattactaatatatttaggccaggattcagcccgacagctgactcccttgcattgaaagatagtttttgcacacatgtaactgaagccacaaaaccggaaataaataaggaagatggagaaattctaggatttgacatttattcccagccttttggtgaaaatgcagattatccatgtgaagataaagttgataatataaggcaagaatcagggccagtgagtaactctgaaatctccctttcttttgacttgagtcgtaatacagatgtgaatcatacgtctgaaaatcagaacagtgaatctttgtttactgaaccttctaatgtcacaacaatagatgatggaagcagatgtttctttacaaaatcaaaaactgactataatgataccaaaaataaaaaggaggtagaatcaagaattagcaaaaggaagctacatatatcttccagggatcagaacataccacataaagatttaagacgacataaaatttatgggagaaagaggaggctaaccagtcaagactcatctgagtgtttctcttcattatcccaaggacgaattaaaacattttcacagtcagaaaagcacattaagagtgtcctaaatatcctaagtgatgaagcatctttatgtaaaagcaaatgtctttccagaaaactagacaaagcagttgttcacttaaaaaaagctcatagaagagttcacacatctttgcagcttataactaaagtaggagaagaaagaaagggcccattaccaaaatcatatgcaataatatgcaataatttctgggaaagttgtgaccttcaaggttatagttctgtgtctcaaagaaaatattattctactaagcatttttcgtcaaaaagaaaatatgacaaacggagaaagaaaagagctccaaaagctgatatttctaaatcattaacccatgtgtcaaagcacaagtcttataaaacaagtggagagaaaaaatgcctttctaggaaaagtatggctagcagtgtctcaaaaagtcaccccaccaccagtcacatgggagaattttgtaatcaagaacatcctgaatcacagttgcctgtatcctccacatcccaaagtacaagtcagtcagtttattataatagcagtgtaagcaatccaagtttatcagaagaacatcagcccttttctggaaaaactgcatatctgttttccccagaccactcagatgagaaactaatagaaaaagaaaatcaaattgatacagcatttttatctagcactagtaaatatgaaaagcttgaaaaacattcagcaaatcataatgttaaagatgcaactaaagaaaacagttgtgacgctaatgaagtaataaatgaaagtaattctgtatctttaagttgcataaaagaaaacataaattctagtacaggcaacgattgtgatgcaacttgcataggtcacacaaaggcgaaaactgacgtacttatatcagtcttagattcaaatgtgaagcactttttaaatgatctctaccaacaaggtaaccttattttatctgattgtaaaagaaacctggaagtaaagtggacagatcctattgagagacccaaacaaaacattattacaggaaacttccttatgggcccattaaacctaactttgatagcaagtaaaaagtacagtattcctcagttatcagccgctgcagtgacagatagtgagggagaatcttcaaaatcttacttggataagcagagaattcttactgtagattcttttgcagcatccagtactgtaccacactgtgagcagagctgtagagaaaaagagcttctaaagacagaacagtgctcttcaggtaattgcctccatacagatgggaatgaaacaaatgtcactgagaattatgagttggatgtagcatcaggaactgaagaagataaaagttatggggaaaatatagtggaattatcttccagtgatagttctctgcttttaaaagataatgtaaaaggctcctcttcagaaacatgtattgtgaagaaagacactgaggacagaataacgtggaaagttaaacaagcggaaaaagcaaaagattctgtttacaaaagaagcatgactgaaggatcaactgttaatactgagtacaaaaatcaaaagaatcagatctcagaagaatcctgcttaaatgagaaaattattacaactaacttgattgattcccatctgagcactaaaaatactaccactgagtcagtccctttgaagaacacagtttctaatccgcttaacaaaagagagaagaagggggaaattaaagttagtaaagactcgcagtctgacttgacattacattcagaaatagcctatatttccaaaccaggaattctaggagttaatcatacgcctattttacctgcccactctgaaacctgtaaagtccctactcttctgaagaaacctgcgtcatacgtgagtgattttaaagaaaaacattgctcagctaatcatacggcccttatagctaatctatctcaaattttgcagagggcagatgaagcatcatctttgcagattctacaggaagaaactaaggtttgtctaaatattctccctttatttgtggaagcttttgaaagaaagcaagaatgttcagttgaacaaatcctgatttcaagagaactgttggtagaccaaaacctgtggaataattgcaaacacacattaaaaccatgtgctgttgacactttggtagaacttcaaatgatgatggaaacaattcaattcattgaaaacaaaaaaaggcacttagaaggtgaaccaacattgcgaagcttgctttggtatgatgaaacactgtatgctgagcttcttggaaaaccacgtggatttcaacagcagtctaatttctatcctggtttccaaggaagattaaaatataatgcattctgtgagttacagacttaccatgatcaattagttgaattgcttgaagaaacaaaaagggaaaagaattcatactatgtattcttaaagtacaaacgacaggttaatgaatgtgaagccataatggagcattgttccgattgctttgatttttctctttctgttccatttacctgtggagttaactttggagatagtttagaagacctggaaatcttaagaaaaagtactttaaagttgatcaatgtatgtggggactctcctaaagttcattcgtatccaggaaaacaggaccatctgtggattatcatagaaatgatctcctcaaaggttaattttattaagaacaacgaggcagtacgtgttaaaatatctctttatggtctggaacatatcttttttgatgctgcaaaaaatcttgtttggaaagagagaacacaatccttcagcaaaaaatactcacaaaagaaggacgaagaaaggctactcagagtgaataaatgtgccttttctaagttgcagaagatatatgatactttgtctaaagatttaaacaatgaaccaatttcccctattgggcttgaggaggatactataattgcttccagaaagtcagatcatccaataaacgaagcaacaattagcatagaaaattctaaatttaacagtaatttgcttgcacacccagatatttgttgtattagtgagatattggatcaggctgaatttgcagaccttaaaaaattacaggatctcaccttgagatgtacagatcacttagaaattttaaaaaaatactttcagatgctacaagataataacatggataatatttttatcacagaagaaaatgttttagacgtggtgataaaccacagccatgaggctatcattttaaagcctgaagctattgaaatgtatattgaaatcgtcatggtctcagaaacaattcactttcttaaaaactcaatagcaaagaaactagacaaacagaggtttcgaggtatgctttggtttgatttgtcacttcttcctgagctggttcagtgccaagaaaaaatggcttctttttcatttcttaaagataactcaacagatgtttgcctttggaaagtgatagagactgctgtttccgaacttaagaaagatctggatattatctgcaaatataatgaagctgttaattgctcatatgctattcatttgctctcaagagaacttcaagaactttcagaaataaaaaagcttctgaagaagtccaagtattttatttccacatatattgactttgtgccatatatagcatccataaattatggaagcactgtgacagagttagaatacaactacaatcaattttctacactgctgaagaatgtaatgtctgcccctaggaaagatttaggaaaaatggcccacattaggaaagtcatgaaaacgattgaacatatgaagatgatatgtactaaaaatgctgaactaaccatttcctttttcctatgccaaatgctgtataacagaaggaagattttacagctgaagagaaaagaaaaaatgaatattcatattgtaaaacctggggaaaataacaataaatttagtatttctacgatgttgcccccagtatcagagtgcataaacaaaaacatctcaaattcctctaaaaaacgaccgagcactgtagacaaatgtgaagactctcaggaacaacagcaagatactactgtttccagttgtaaaaagctaaaggtagacatgaaagatgtcacaaaaatcaacagagaaaaggcaacattcaagcatccaaggactacaggatctcatcccaaaagcgaaaacaaaatagtaccaagttcatgtgacagtctgaaaagaaatcatttaacgccaaaaaaggttgaaatgcaaagatcactacctggctcacttttacccttagagaacccaaaagacacttgcgcatcaaagtcggaaagcaaaatagacttaactgtttcatctgatcacttcagtggacaacaggaaaatttaaatagcatgaagaaaagaaatgtgaacttcagtgctgctgaaacaaaaagtgataagaaagattgtgctgcttttgcaatttgtgaccaaaaaagtgtacatggcacattttcaccagaccatgggacgcttttgcagaaatttcttaaaaattccccagatcccacccaaaaatcctgcctttctgatataaacccagaaactgatgtttctcttgtgcctgatgcgtcggtgctctcaaagccaattttctgttttgtgaaagatgtccatcctgatctagaaatgaatgacacagtctttgaacttcaagataatgatatagtaaattcatctattaaaaattcctcatgcatgacttctccagaacccatctgtatccagaacaaaattcctactctgcagataaacaaactacagcctacagaaactgagtcagaggacaaatacatgaaggatacattgaatcccaatactgtgcatacttttggagcatctgggcatataacccttaatgtgaatcaaggagcagagtactctctttctgaacaacagaatgacaaaaattcaaaagtcctaatgcagaatgctgccacatattggaatgaacttccacagtctgcatgtaacccaacatataattcttctgagcatttatttggaacttcatatccatactctgcttggtgtgtttatcagtacagcaacagcaatggcaatgccattacccagacataccaagggataacatcatatgaagtacagccatctccttctgggctgttgaccacagttgcaagtactgcccagggcacacattctaatcttctgtactctcaatattttacttattttgcgggggagccacaagcaaatggctttgtgccagtgaatgggtattttcaatctcaaatacctgcttctaattttcggcagccaattttttcacaatatgcttctcatcagccattaccacaagctacatacccttaccttcctaatcgatttgtgcctccagaagttccttgggtttatgctccatggcaccaagaatcctttcatccaggacactgaaaatagtcttctgtctattgaaataagacataacaagtttttccaaatattttttacttatatattttttaacatttagcgatttttaatgtttgtaaatgtggtaggaaatataaatcatatggtcctttgtaaaatatacaaataatctaacacatatcatataggacatcaatttctaacatctgatataccagaattatttccatgcaattataaggggagggtaatatgatcaaagttaagcaatagtggtaaaatctttaaaactagattcttgcttctgatatgtttcaatacattgttgatggcattgtgccatttgagctgaaagcaggattttttttcattagtcatcaaaccaagaattttataattcttgacactttattatataatttacaattctatgccagatatggcaaatttcttcaatttcagtattttatagtttctacttgtaaaatatttttaataagaaaaattggtttgcataatctcagtgtttccttgagtagagatgttttaaatgtttatgttggaagcaattgtagttaattatattggcaatgaagcactttcaatgcctttttctacaagagccatttccagaagattattttgtttttggatttcacaatttaaatagttattttaatgattttctagcaaataatagagaataatgtttatgcttatgcagttagtctttattacagtaatttaaacaatgtggcacaaacatagttttttcatgctcttgtcatagacttttctttttaaccttctgcaaaagtaaaaactctcttagtaataatcatcatagggcaacaggatatagtatgtaactgcagtcttgagctgtctcttttcatgtattacctttcttgctcaacagctattcctgttttctgtaagatcctagtcagacagagccctcacaactggatagacctttctcaagggttagccctaaaatgtgacaagagaattggtttggctgaatcacaacaaataactagcaaagcttcagtgcttttgcaaactttttatgtaagcaaactttttgtgttatctggcacaggcctttgaaaagactataattctactttgtttaatgtagagtaactaatttttcaatttagaaagacagtgagaatccccaggataagcctctttatactcacttaaaccaactgggatggaattcagaatacctaagctgcttctttaacatagagatctttaaaaagggaaggtcaagcaaagaactgtaaccgaaagaagtaagagatttgaaaagacgatagagttaaaacaatatttaaaaaacatttctatttggtccatgcagttttatttgaaaatagtctgtcaaaatcagaactcctgaacaactttgaaagcagtaatattaactggtattcaaaaatgaataacagccaaaaatgaataacagccatttgatttatgtttccctcagtcatttggtttatgtttggttatggcaagatgttacagcatttatagttaatactactactaatatgtaaaccaaaagttaaatattctagttaaggattgtttctttaaacaactttcagattctgttgacattgtctttgtggtatttttatttcatgggttttaatttctcttaaagacttacctaaatattcagttacatttttaaaaaatctgtacgtgacagaatattaaaacatggaatatttttgcttcaa

SEQ ID NO: 190187 - DNA, 1936 bp, Homo sapiens
  Payload ID: 17558
  Gene Symbol: TEX19
  Gene Name: testis expressed 19
  Uniprot ID: Q8NA77
  ENST ID: ENST00000333437
  CDS Start-End: 311-805
ctttccctgggtgcccacatgaacagagacaccaggatgctctcctgagaccacagcaactgcagaagctgaagacatttccagaagttcaagcttccaccctctgcaggtccccactgagctgggacccaggtcatccaccccaccccaaatccctggataggaaacccctttctcctcctgctccttgtccccttcatccctgccgcccagcatcctactggcctcagcacctgtggccagaccgtccaagatcctctgaaggcccagctcttgctgtccaccccggcagtaggcaggcagcctggccatgtgccctccggtcagcatgcggtatgaggaagagggcatgtcctacctctacgcctcctggatgtatcagcttcaacatggagatcagctaagcatttgcttcacctgcttcaaggctgcctttctagactttaaagacttgctggagtcagaggactgggaagaagacaactgggaccctgagctgatggagcacactgaggcagagtcagagcaggaggggtcctcagggatggagctgagctgggggcagagcccaggacagcctgtgcaggggggctctgaggcatgggggccagggaccctggcagcagccccagaagggttggaagatgcaggtctggacccccactttgtccccactgaactatggcctcaggaggctgtgcccctgggcctgggccttgaggatgctgactggacccagggtcttccctggagatttgaggagcttcttacctgctcacactggccaagcttctttccttcatagcaggggtttctcaaagtggacctgcccccaggggagcccgtggtgttgaagctgggcattacctgggcagtggaccctgccgaggctgaggcctagttactggccctgcagcttgtctccatggtgggctgctatgataccatctacctacagaagatgaccccagacagggccctgaggaccccagggcagcactggaaattgctgctggagcctggtgaagtgtgggtggtgagactccaagatgcaccccaagagcaggacctgcactggtggatgctgagcattctagaaacatcgttaacaggacacagggcagagctggtccctgcagcctcagccctgcagaagaggattcaccatagtctcttattcaccctggaccaacagggagagcaagaagggagactcagcctgtaagccacagtcctccagccaagaacaggatctcagcacccctgagacacagagcaggggtcctgaggaaagcctggctgttgcaggagcctcggccatgggggagctgccctgtttccagcctcagtccagggccccagaactgagagactaaggctcatgtagctgccattgtcctgggcacaccaggacatcagagactgggaagggccagcaattgctgttccacaacagccaggggagcagttggcaaaggaaacatggggagcaactttaggggctgggagatagggcctgttgtggcctcagagggaagcattacaaatattcataacctggaaacaagttcttaccagttgattgtcacatagttctggatgtgttggcctgaatggctgttgtgctgcttgtgacatggggggcagggcacagaacttgtgcctatttcaccttggccatggggagggacattgcttgtaaaacacatgctctgcagaacacaccagaatctgtggtgacctggatgtgttctcgactttgccaggacaatctcaggggtgccacaagaccctgtcagcagcactaggatctctggtctacagtggagggagagctggttttaaatgttggccgttgatgcaatttaaccatttaattcctgttgctctatatgttgtttttaattttaaaaagtcataaaagctttcaaacaag

SEQ ID NO: 190188 - DNA, 5232 bp, Homo sapiens
  Payload ID: 17559
  Gene Symbol: TEX2
  Gene Name: testis expressed 2
  Uniprot ID: Q8IWB9
  ENST ID: ENST00000258991
  CDS Start-End: 86-3490
gtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattttgcccgtctccaagaacactgtaaagctgttggagtcccctgttccagcagcacaagtattaagtacagtgccattggctgtgtccccagggtcgtcttcgtcggggcccttagctagctctcccagtgtgtcatccctttctgagcagaaaaccagttcttcctccccattgtcctctccttctaagtctcccatcctctcatccagtgcctcaacctccaccctttccagtgcaaaacccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagcccccgtcttcttggctccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaaatactagataagcatctaagtcatttctacggaatcctgttcagataggggcacaataaaatgagtacagagcaccggggccctcacctggcaatcgcagctttcatttactgcgttgatcactgcccagtcctaaggctacaaagccatcctcactacatccttcaaactatgtgccattatcttcagcccacatttaaagaatccagtgaaa

SEQ ID NO: 190189 - DNA, 458 bp, Homo sapiens
  Payload ID: 17559
  Gene Symbol: TEX2
  Gene Name: testis expressed 2
  ENST ID: ENST00000583738
  CDS Start-End: 331-458
gtgccccagccgaagccggagtcgcgcggccgggagcacgggcgccggcatagtacaatgaggcagccagcggatcttggcagaaacaaccttatacaaagtggttccgtggaggagagaattaccatgttatagtcctcaggaaggcttttgttcctggaaaggataccattgaatagtgacatctgagttttaaggtaataacagaaaaaacttggaaataaacatcccattatttgacctccaaggcagaagactggcaccaaggaaatggcagcttcgtccctttcctgtcttgggcattgagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcga

SEQ ID NO: 190190 - DNA, 1966 bp, Homo sapiens
  Payload ID: 17559
  Gene Symbol: TEX2
  Gene Name: testis expressed 2
  ENST ID: ENST00000583501
  CDS Start-End: 1-1880
tgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaagggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcct

SEQ ID NO: 190191 - DNA, 4852 bp, Homo sapiens
  Payload ID: 17559
  Gene Symbol: TEX2
  Gene Name: testis expressed 2
  Uniprot ID: Q8IWB9
  ENST ID: ENST00000583097
  CDS Start-End: 174-3557
gacaatggaggaagcttccctcagtttacagcagaaccccaggctcagggaggtgaagtggggagctccgtcactgtcatttgagggccatttgagggctgtggtcctccgtggagctcctccctctgctgcctcatggcctcactcgagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattttgcccgtctccaagaacactgtaaagctgttggagtcccctgttccagcagcacaagtattaagtacagtgccattggctgtgtccccagggtcgtcttcgtcggggcccttagctagctctcccagtgtgtcatccctttctgagcagaaaaccagttcttcctccccattgtcctctccttctaagtctcccatcctctcatccagtgcctcaacctccaccctttccagtgcaaaacccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccatt

SEQ ID NO: 190192 - DNA, 4825 bp, Homo sapiens
  Payload ID: 17559
  Gene Symbol: TEX2
  Gene Name: testis expressed 2
  Uniprot ID: Q8IWB9
  ENST ID: ENST00000584379
  CDS Start-End: 160-3543
ggggcggcgtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattttgcccgtctccaagaacactgtaaagctgttggagtcccctgttccagcagcacaagtattaagtacagtgccattggctgtgtccccagggtcgtcttcgtcggggcccttagctagctctcccagtgtgtcatccctttctgagcagaaaaccagttcttcctccccattgtcctctccttctaagtctcccatcctctcatccagtgcctcaacctccaccctttccagtgcaaaacccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaa

SEQ ID NO: 190193 - DNA, 563 bp, Homo sapiens
  Payload ID: 17559
  Gene Symbol: TEX2
  Gene Name: testis expressed 2
  ENST ID: ENST00000583922
  CDS Start-End: 407-563
aaggtagattatgttggactttctgtggtgtgctaagcattcagcacccgtacctgggagacttggccctacctgtaggcatctctgcagtgggtgcagtcctgagtgtggagcaaggtggaccggaagcagctgttcctctgctcttgcctgcagttgtttgctttagtgtttggatgcgggcagatctttcaccttttttcctgataagaggagacagagactactggccttacagccaggtggtcaaacatgacaactcggagttgctgtgtgcaaaacctgcctgaaccccatctccagcgagatttgatgatgtttccccattcaaaggaacaaccacgcctcaggaccatacaaggagaggacttcatgaaacagagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttca

SEQ ID NO: 190194 - DNA, 4852 bp, Homo sapiens
  Payload ID: 17559
  Gene Symbol: TEX2
  Gene Name: testis expressed 2
  ENST ID: ENST00000615733
  CDS Start-End: 174-3557
gacaatggaggaagcttccctcagtttacagcagaaccccaggctcagggaggtgaagtggggagctccgtcactgtcatttgagggccatttgagggctgtggtcctccgtggagctcctccctctgctgcctcatggcctcactcgagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattttgcccgtctccaagaacactgtaaagctgttggagtcccctgttccagcagcacaagtattaagtacagtgccattggctgtgtccccagggtcgtcttcgtcggggcccttagctagctctcccagtgtgtcatccctttctgagcagaaaaccagttcttcctccccattgtcctctccttctaagtctcccatcctctcatccagtgcctcaacctccaccctttccagtgcaaaacccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaactcagggcttttgccgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccatt

SEQ ID NO: 190195 - DNA, 2571 bp, Homo sapiens
  Payload ID: 17560
  Gene Symbol: TEX22
  Gene Name: testis expressed 22
  Uniprot ID: C9J3V5
  ENST ID: ENST00000451127
  CDS Start-End: 93-545
ctcaagccgcggtgtactccagcggccccctgtggcctctccatccgcggcggatctcagaggtgtggacaagcagcctactagggctagagatggacagcaggaaactgtccccccgggggaagaagctggagtcgcacctctcccaagagcacaggcggcccccactgggcctgatagcagcctggggccagcccagtatccagagcagcgttcagcagggactgcagactcaggactgggtgtgcgagccgccggaacgcaggcgcccgggccgccgctggagcgtcagcatcgacgagcgccggcggctggccacgctgggcggccgggagaggccgggcgccgccgggacccagctgcactgcagggacgtcgtgcagatggtagcccagctggtgtcggaggacgtggacaaggacgtgctccttccccacccgctgaggtccaccgagtccaccaacgccttccaggccttcctggcgcgcagtgcgcctttctggcataatgcgactttcgaggcctcgaggtcacccccttcctaagagccccattcagcccattgtctgtcttccagtgcctttccttgggggcccacggtgggggcagcctctgcgccttctttgtgccccaccagggggtcaccacccacccatgttaggaaaacaggccaggcaggacctggctccggacagcctgcagctgctgaggccttggagaccgggctaggggctatgggaggccatctaggggaggggaacactgccccgggtcagtctgagagggccctggcaaggcctgggtagcaggagcttgccctcggggccgctgggaggaggcctggggtacctgggcctgcctgaggtgcactggtgtcctgggaagccccagtggcaggcgctgcctggagactcagctccttggctggcctggtctggggaactgggtatctgcctgcaccaggctgtgagatgggccaggcagagttctccagggggcggggtctcacattgggtcctgcctctgaagacccagaagggcacacgggaccccaggggtgctgtggtggggagcagcaagcccagggacccaatgcagtgcccagcacagagggaggctgtctggaggcagagatgcctcctggcctctggacagcgatgctggtggtggacgagggccaagagggtatcctgcgcagggggtctgagcaactgtgaggagctggctgccgcaggggcctgtgggacatggtccactgggtgactgcctcgtttccaggctgcagggccctcggaagggtgctgagccggggtaacgtgtcccagctgcattttggggacactaagttgcagggggactggattgggaggcggggcaggagagctgtgagcatgggttcccagcccggggtgggtgggggtggggaaagggccctgaactctgtgactgactgttaggggcctgactgggcttctgtggaggtggctaggtggaggaggctttggggcaagcggaggtgatcactcctgggctccaggtgagggcaggagctggacctgtgcggtggcctggaccaccagatacactacatgctggctgtgctgcccacctggcctgtaaccctccccttcccgctgctgagaagccacctgactgcactgccagccacctgctgccctgacacaggatccctggcccgagttgaatcctctgcacctgcctgtctccccttcttactgtaagactcagtgaagttccctcctccttcaggaagccttccaagattacacagccaggtgctccccttctctcccaagtcctctgaatgtcatttggtgcaccctagggatcctctgcatttctcaggagccctagggtaggtggatggagggcagatcctccaggggctagggcaggtgtccttaagggtgtggggagttttgggcagggcactgtccttaagggtgtggggagttttgggtcatgacccaccccctctgaggcccctgatgatgatgtggggaatgggatcctatgggcccagctgcatgccaggcaggcatccccaggtgtaaacagggcagagcggagctgacaggtaagcagttgccatgggggtgatgagctgggcagtcctctgttgctgagtggctttaaagaaccactcgttgttctgtgacttgggggttggctgggctcatcctgccagctctcctgctctcgtttgagtgtctcctgaggctgcagtcagagcgtggtggtccaggatgctggtgatgctgggatggttgccctctctgctccatgaggtctccctacagagcacctcccccatggtggcagcagagacaaaaccctggcctccttcaggctgaggcccagagccagtctcctggtgggtaaggtggccacagggccagctggcagcagggtattggcactgagaggcacaggcctctccaacagaggtggtgccgggacaggggcagtgcctggagaccgcttaggttgtcacaactgggatttgtgtactagttttctgtagctgccataaaaattgccacaaattca

SEQ ID NO: 190196 - DNA, 508 bp, Homo sapiens
  Payload ID: 17560
  Gene Symbol: TEX22
  Gene Name: testis expressed 22
  ENST ID: ENST00000548638
  CDS Start-End: 97-288
ccccctcaagccgcggtgtactccagcggccccctgtggcctctccatccgcggcggatctcagaggtgtggacaagcagcctactagggctagagatggacagcaggaaactgtccccccgggggaagaagctggagtcgcacctctcccaagagcacaggcggcccccactgggcctgatagcagcctggggccagcccagtatccagagcagcgttcagcagggactgcagactcaggactggactacgtctactttgagaactcctccagcaacccatacctgatccggagaatcgaggagctcaacaagacggccaatgggaacgtggaggccaaagtggtgtgcttctaccggaggcgggacatctccagcaccctcatcgccctggccgacaagcacgcaaccctgtcagtctgctataaggccggaccgggggcggacaacggcgaggaaggggaaatagaagaggaaatggagaacccggaaatggtggacctgcccga

SEQ ID NO: 190197 - DNA, 1478 bp, Homo sapiens
  Payload ID: 17561
  Gene Symbol: TEX26
  Gene Name: testis expressed 26
  Uniprot ID: Q8N6G2
  ENST ID: ENST00000380473
  CDS Start-End: 14-883
ctcctggggcagaatggaacagcctgggcccagggctccggatccctctctctgccaccacaacctccagccaacagatgaccccaactgggattcctatgctaccactatgaggactgcattcacgcctaaaacaggagcagtgcctgccttaattcgccaaaacggtatcagaagattaggatatacatattcacttagtgatcctattctcaatcagacacaatatagtgatgagtacacttggaaatcacactctaaagaagatttgatcaaaactgagacttcaagaggaatcaagagccacaaatctcatctcaatgaagacattttcctgtggacactacctcactgtcaacaaacggggacactaaagaactgcctcccttggaaaatcccggcttcaatgaaagaagttaacaaggcactatcaaatcagtttatttcccttactaagagagactttgtggacagatcaaaagctcagaagattaagaaaagttctcacttgtctctggaatggaaaaagttacttccccaacctccagacactgaattccgaaggaattaccaaattccagctaaaattcctgagcttcaagatttcagtttcaaatatggatgctactcaagcttgcctgttgcttctcagggtctagtgccttctgtgctgcacagctacctgaggaaccaagagcacacaaagaaacagaccacataccaaagtgactacgacaaaacctacccagatttcttaatgcttttaaactcatttacttcctctcaagtcaaagagtaccttcagagtctttcctacaaagatagacaaattattgatcgctttattcgtactcactgtgacactaacaaaaagaagaaatgaaaagggaaaatagtacaaatgaagaaaatctgaaaatcaatggaagcacgaggacattcctagtcattttctcaattatcaaggaaaaataagatgcaaatagcttcaagtatgatgtgatagtcatgaatttgtgtcttttgctccgctttatttttaaacaataaaattaaggctacaaaattttccctgaacatagctttagctgtatccaatagtttttgatacaatgtttttttcttttcccttttggatacttaatttgtagtttcaattttgatttctcctgtgaactaggaattatgtggaagagatttcttaatgtcccattaatcagagacttaagaaatcattttattgccttatctcttctttgaatgaatgaaagtttaaaaatctgcttttgggaaatcaattgcagttttatttaatgccattaatcaagtatatgattaatttgtgtgttacgtgaatatgagaaaaaaattatagtttattgtattttttaatcccttatatctttaattgtatacttgaattgttcaattctgaaagaatattggaacctcccacaataaatatatttttatcaatt

SEQ ID NO: 190198 - DNA, 804 bp, Homo sapiens
  Payload ID: 17561
  Gene Symbol: TEX26
  Gene Name: testis expressed 26
  ENST ID: ENST00000531960
  CDS Start-End: 1-186
cctgggcccagggctccggatccctctctctgccaccacaacctccagccaacagatgaccccaactgggattcctatgctaccactatgaggactgcattcacgcctaaaacaggagcagtgcctgccttaattcggacattttcctgtggacactacctcactgtcaacaaacggggacactaaagaactgcctcccttggaaaatcccggcttcaatgaaagaagttaacaaggcactatcaaatcagtttatttcccttactaagagagactttgtggacagatcaaaagctcagaagattaagaaaagttctcacttgtctctggaatggaaaaagttacttccccaacctccagacactgaattccgaaggaattaccaaattccagctaaaattcctgagcttcaagatttcagtttcaaatatggatgctactcaagcttgcctgttgcttctcagggtctagtgccttctgtgctgcacagctacctgaggaaccaagagcacacaaagaaacagaccacataccaaagtgactacgacaaaacctacccagatttcttaatgcttttaaactcatttacttcctctcaagtcaaagagtaccttcagagtctttcctacaaagatagacaaattattgatcgctttattcgtactcactgtgacactaacaaaaagaagaaatgaaaagggaaaatagtacaaatgaagaaaatctgaaaatcaatggaagcacgaggacattcctagtcattttctcaattatcaaggaaaaataagatgcaaatagcttcaa

SEQ ID NO: 190199 - DNA, 3441 bp, Homo sapiens
  Payload ID: 17562
  Gene Symbol: TEX261
  Gene Name: testis expressed 261
  Uniprot ID: Q6UWH6
  ENST ID: ENST00000272438
  CDS Start-End: 189-779
gcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccagggcttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaatgaa

SEQ ID NO: 190200 - DNA, 758 bp, Homo sapiens
  Payload ID: 17562
  Gene Symbol: TEX261
  Gene Name: testis expressed 261
  ENST ID: ENST00000433258
  CDS Start-End: 76-231
tggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctgggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgag

SEQ ID NO: 190201 - DNA, 1340 bp, Homo sapiens
  Payload ID: 17563
  Gene Symbol: TEX264
  Gene Name: testis expressed 264
  Uniprot ID: Q9Y6I9
  ENST ID: ENST00000341333
  CDS Start-End: 92-1033
gtaaccgaaccctgagccgcctgcgcggatcggcgtccgcagcgggcggctgctgagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccacccctgttgtgtctttttttcagactcacagtggagcttccaggacccagaataaagccaatgatttacttgtttcacctgga

SEQ ID NO: 190202 - DNA, 1555 bp, Homo sapiens
  Payload ID: 17563
  Gene Symbol: TEX264
  Gene Name: testis expressed 264
  Uniprot ID: Q9Y6I9
  ENST ID: ENST00000395057
  CDS Start-End: 309-1250
cgggcggctgctgaggtgagggccgggccagaggagaggcatacccactggggcgtaggtctgggactccccctgtccgccctggcgcgacctcaggactctccgtgtcccctccgtgacccccgcggcccgggccgctctttgcatcttgtcttgcccacagctggcctcggccaggtccgagggcctggatgcgaccttggggcagcccctactcttccgggcagcccacttccgcggccaccggtgcagggcatgccccggggccgtggagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccacccctgttgtgtctttttttcagactcacagtggagcttccaggacccagaataaagccaatgatttacttgtttcacctg

SEQ ID NO: 190203 - DNA, 596 bp, Homo sapiens
  Payload ID: 17563
  Gene Symbol: TEX264
  Gene Name: testis expressed 264
  ENST ID: ENST00000412249
  CDS Start-End: 178-596
gaaccctgagccgcctgcgcggatcggcgtccgcagcgggcggctgctgaggggtgactgttctttcagctcccagcactggagcgctcggcccctgccgcactggatgccagcagttactaaaagtgagcctggcatttcagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccac

SEQ ID NO: 190204 - DNA, 2290 bp, Homo sapiens
  Payload ID: 17563
  Gene Symbol: TEX264
  Gene Name: testis expressed 264
  Uniprot ID: Q9Y6I9
  ENST ID: ENST00000415259
  CDS Start-End: 1082-2023
cgcggatcggcgtccgcagcgggcggctgctgaggtgagggccgggccagaggagaggcatacccactggggcgtaggtctgggactccccctgtccgccctggcgcgacctcaggactctccgtgtcccctccgtgacccccgcggcccgggccgctctttgcatcttgtcttgcccacagctggcctcggccaggtccgagggcctggatgcgaccttggggcagcccctactcttccgggcagcccacttccgcggccaccggtgcagggcatgccccggggccgtggaggtgagggaaagaggcgcgagtcgcgttttaactccgcccccgtcccccaaggccgcgcctcgcagcctgggctgcaaactttagcgtcctttaagttacagacgtgcgtggggctccgtgaggaggtgggcgaagagaaaggctctgagtaaataggcaaggcccggggtgagcaggggctggaatccgaaagtgggaggcggcggccccccaccctccatagtccttccgccctctgctagcaccgaagtttagcccaggacgggggccgtttaagggcccggccctccgccgccgcgcacgtgagcggcaccaggaagctggctgggcgcagccttccctgaggctcgctggcaccggccgcacgcgtccatcccgggcctctgagcggagggggagccgaggctagagggagggcgcagtctgcccaaggtcagcggcagcggcagtttctgggcgccaagtgtgattggagtactccaggaagaggggcgtgaccagagctctagcgaagagacctgacattgtaaagctaggtttggcttctgatttccacagggggtttgagaatgggacgagggtgctttagagggaccggtaggctttccctgaggacggtaatcagggcatgatggttggctcagtggttatttcctgggcaggggtgactgttctttcagctcccagcactggagcgctcggcccctgccgcactggatgccagcagttactaaaagtgagcctggcatttcagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccacccctgttgtgtctttttttcagactcacagtggagcttccag

SEQ ID NO: 190205 - DNA, 1313 bp, Homo sapiens
  Payload ID: 17563
  Gene Symbol: TEX264
  Gene Name: testis expressed 264
  Uniprot ID: Q9Y6I9
  ENST ID: ENST00000416589
  CDS Start-End: 71-1012
ccgggccagaggagaggcatacccactggggcgtagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccacccctgttgtgtctttttttcagactcacagtggagcttccaggacccagaataaagccaatgatttacttgtttca

SEQ ID NO: 190206 - DNA, 583 bp, Homo sapiens
  Payload ID: 17563
  Gene Symbol: TEX264
  Gene Name: testis expressed 264
  ENST ID: ENST00000425781
  CDS Start-End: 131-583
gagccgcctgcgcggatcggcgtccgcagcgggcggctgctgaggggaaattcacgttacctctccacgtgccgaccaaggctctgagacccccagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtc

SEQ ID NO: 190207 - DNA, 1155 bp, Homo sapiens
  Payload ID: 17563
  Gene Symbol: TEX264
  Gene Name: testis expressed 264
  ENST ID: ENST00000457927
  CDS Start-End: 509-1155
ccggccctccgccgccgcgcacgtgagcggcaccaggaagctggctgggcgcagccttccctgaggctcgctggcaccggccgcacgcgtccatcccgggcctctgagcggagggggagccgaggctagagggagggcgcagtctgcccaaggtcagcggcagcggcagtttctgggcgccaagtgtgattggagtactccaggaagaggggcgtgaccagagctctagcgaagagacctgacattgtaaagctaggtttggcttctgatttccacagggggtttgagaatgggacgagggtgctttagagggaccggtaggctttccctgaggacggtaatcagggcatgatggttggctcagtggttatttcctgggcaggggtgactgttctttcagctcccagcactggagcgctcggcccctgccgcactggatgccagcagttactaaaagtgagcctggcatttcagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcac

SEQ ID NO: 190208 - DNA, 1448 bp, Homo sapiens
  Payload ID: 17563
  Gene Symbol: TEX264
  Gene Name: testis expressed 264
  Uniprot ID: Q9Y6I9
  ENST ID: ENST00000457573
  CDS Start-End: 201-1142
atgtcccgccgcgagagggggcggagcgagcgtgcgcggcgggcgcgcgcaggctccgtaaccgaaccctgagccgcctgcgcggatcggcgtccgcagcgggcggctgctgaggggaaattcacgttacctctccacgtgccgaccaaggctctgagacccccagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccacccctgttgtgtctttttttcagactcacagtggagcttccaggacccagaataaagccaatgatttacttgtttcacctgg

SEQ ID NO: 190209 - DNA, 531 bp, Homo sapiens
  Payload ID: 17563
  Gene Symbol: TEX264
  Gene Name: testis expressed 264
  ENST ID: ENST00000419358
  CDS Start-End: 219-531
tagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacggctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgagg

SEQ ID NO: 190210 - DNA, 873 bp, Homo sapiens
  Payload ID: 17563
  Gene Symbol: TEX264
  Gene Name: testis expressed 264
  ENST ID: ENST00000444233
  CDS Start-End: 224-873
tcgctggcaccggccgcacgcgtccatcccgggcctctgagcggagggggagccgaggctagagggagggcgcagtctgcccaaggtcagcggcagcggcagtttctgggcgccaagtgtgattggagtactccaggaagaggggcgtgaccagagctctagcgaagagacctgacattgtaaagctagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacagg

SEQ ID NO: 190211 - DNA, 1488 bp, Homo sapiens
  Payload ID: 17563
  Gene Symbol: TEX264
  Gene Name: testis expressed 264
  Uniprot ID: Q9Y6I9
  ENST ID: ENST00000611400
  CDS Start-End: 241-1182
atgtcccgccgcgagagggggcggagcgagcgtgcgcggcgggcgcgcgcaggctccgtaaccgaaccctgagccgcctgcgcggatcggcgtccgcagcgggcggctgctgaggggtgactgttctttcagctcccagcactggagcgctcggcccctgccgcactggatgccagcagttactaaaagtgagcctggcatttcagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgtgtccatcctgccttggacacctacatcaaggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccacccctgttgtgtctttttttcagactcacagtggagcttccaggacccagaataaagccaatgatttacttgtttcacctgg

SEQ ID NO: 190212 - DNA, 1174 bp, Homo sapiens
  Payload ID: 17563
  Gene Symbol: TEX264
  Gene Name: testis expressed 264
  ENST ID: ENST00000614067
  CDS Start-End: 149-868
atgtcccgccgcgagagggggcggagcgagcgtgcgcggcgggcgcgcgcaggctccgtaaccgaaccctgagccgcctgcgcggatcggcgtccgcagcgggcggctgctgagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggagcggaagctgtgtgcctatcctcggctggagatctaccaggaagaccagatccatttcatgtgcccactggcacggcagggagacttctatgtgcctgagatgaaggagacagagtggaaatggcgggggcttgtggaggccattgacacccaggtggatggcacaggagctgacacaatgagtgacacgagttctgtaagcttggaagtgagccctggcagccgggagacttcagctgccacactgtcacctggggcgagcagccgtggctgggatgacggtgacacccgcagcgagcacagctacagcgagtcaggtgccagcggctcctcttttgaggagctggacttggagggcgaggggcccttaggggagtcacggctggaccctgggactgagcccctggggactaccaagtggctctgggagcccactgcccctgagaagggcaaggagtaacccatggcctgcaccctcctgcagtgcagttgctgaggaactgagcagactctccagcagactctccagccctcttcctccttcctctgggggaggaggggttcctgagggacctgacttcccctgctccaggcctcttgctaagccttctcctcactgccctttaggctcccagggccagaggagccagggactattttctgcaccagcccccagggctgccacccctgttgtgtctttttttcagactcacagtggagcttccaggacccagaataaagccaatgatttacttgtttcacctgg

SEQ ID NO: 190213 - DNA, 1549 bp, Homo sapiens
  Payload ID: 17564
  Gene Symbol: TEX28
  Gene Name: testis expressed 28
  Uniprot ID: O15482
  ENST ID: ENST00000619903
  CDS Start-End: 167-1399
gaggcaagccccgtgtgattgttgaggaggagttagcccattgccagcctgtgacgtgactgactcgaatgaaccctgttattctctcagtgtatcgaagatatcagtcaactatcttctggattgcattgatgctattgagaaggcagcctgcagtctaaaagtcatggttttaaaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggcaagcattgatggaagaacaggtgaatggtcgcctgcagggacagctgaatgagatttacaacctcaaacacaatctggcctgcagcgaagagagaatggcctatctatcctatgagagagccaaggaaatatgggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctcaca

SEQ ID NO: 190214 - DNA, 1233 bp, Homo sapiens
  Payload ID: 17564
  Gene Symbol: TEX28
  Gene Name: testis expressed 28
  Uniprot ID: O15482
  ENST ID: ENST00000610938
  CDS Start-End: 1-1233
atggttttaaaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggcaagcattgatggaagaacaggtgaatggtcgcctgcagggacagctgaatgagatttacaacctcaaacacaatctggcctgcagcgaagagagaatggcctatctatcctatgagagagccaaggaaatatgggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaa

SEQ ID NO: 190215 - DNA, 1525 bp, Homo sapiens
  Payload ID: 17564
  Gene Symbol: TEX28
  Gene Name: testis expressed 28
  Uniprot ID: O15482
  ENST ID: ENST00000617225
  CDS Start-End: 145-1377
tggtgccagcactagcccccatgtcggtctcagagaaccttctccccacctctgagttattctctcagtgtatcgaagatatcagtcaactatcttctggattgcattgatgctattgagaaggcagcctgcagtctaaaagtcatggttttaaaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggcaagcattgatggaagaacaggtgaatggtcgcctgcagggacagctgaatgagatttacaacctcaaacacaatctggcctgcagcgaagagagaatggcctatctatcctatgagagagccaaggaaatatgggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctca

SEQ ID NO: 190216 - DNA, 709 bp, Homo sapiens
  Payload ID: 17565
  Gene Symbol: TEX29
  Gene Name: testis expressed 29
  Uniprot ID: Q8N6K0
  ENST ID: ENST00000283547
  CDS Start-End: 130-585
ccagtttgttgttttacctaaaaggtgttttccacgtggagtgggactgagaggcacaggtggctgaggggacccgcctgggatgtgaggcgcaggtgtgctcggccccttcatctgtcagctgcagcaatggaatacgtgctggaagtgaagaactctccgcggcacctcctgaagcaattcacagtgtgtgacgttcctctgtatgacatttgtgactacaacgtctccagggaccgatgccaggagctcgggtgctgcttctacgaaggcgtctgctacaagaaagcggttcccatttacatccacgtgttctctgccttgattgtgatcatcgctggggccttcgtcatcaccatcatctacagagtcattcaggagagcaggaaagaaaaggccatccctgtggatgtcgcgctgccacagaagtccagcgaaaaggcggagttggcctcatccagcagcaagttagggctgaagcctgcgagtcctgggcctccaagtgctgggccctcgatgaagagtgacgaggataaggatgatgtaacagggacaataacagaagccgaagaaactgaggactgactgagacgcatgaagaagtggagattgtcagaattatccaaatgaaatggtacagcaggtgcactgttaacagtgtgatggaatgaccacccaaagagaaaaaaataaaggtattttgaaaatt

SEQ ID NO: 190217 - DNA, 835 bp, Homo sapiens
  Payload ID: 17565
  Gene Symbol: TEX29
  Gene Name: testis expressed 29
  ENST ID: ENST00000497241
  CDS Start-End: 28-282
ggtgagttctcctggaagaagaacctgatgccagccatctgtcaaggaagacaggaagtaacagtgcaggctcagtgtgctcggccccttcatctgtcagctgcagcaatggaatacgtgctggaagtgaagaactctccgcggcacctcctgaagcaattcacagtgtgtgacgttcctctgtatgacatttgtgactacaacgtctccagggaccgatgccaggagctcgggtgctgcttctacgaaggcgtctgctacaagaaagcggttcccatttaggggaggaattgacctgggcattgaggagccatttccagggagctggggagcacagcaggaacagaggggccagcgccatctctccacgcacccccaggggtcaggagccagcaccatctatcctccacacactcccgaggtttacatccacgtgttctctgccttgattgtgatcatcgctggggccttcgtcatcaccatcatctacagagtcattcaggagagcaggaaagaaaaggccatccctgtggatgtcgcgctgccacagaagtccagcgaaaaggcggagttggcctcatccagcagcaagttagggctgaagcctgcgagtcctgggcctccaagtgctgggccctcgatgaagagtgacgaggataaggatgatgtaacagggacaataacagaagccgaagaaactgaggactgactgagacgcatgaagaagtggagattgtcagaattatccaaatgaaatggtacagcaggtgcactgttaacagtgtgatggaatgaccacccaaagagaaaaaaataaaggtattttgaaaattgc

SEQ ID NO: 190218 - DNA, 1689 bp, Homo sapiens
  Payload ID: 17566
  Gene Symbol: TEX30
  Gene Name: testis expressed 30
  ENST ID: ENST00000376019
  CDS Start-End: 838-1398
ccaaccctgcacctggccctctaaccaattctgagtgcccgtagaaaaatgtacatgtaaagacaccagattttagggaagtaattctaaatgtttattttagctactgaatgtgttcattcatagtttttgtgtcatatccatgtctgccaactcacctttcacaacagaatcttcttttcagggagatgtcctttgcttctcagatgtaaatgcactttaagtttgttattcaacagtgaaaatgagtcatacagaggtaatattttcgtatgttctgcatcttcagggttcctggttttttgtttgtttgtaattatgtggcttcagagtaattttattttcaactttcactgtgggaggcagtatagcataagtggttaagagcgaggaatctagagcagactaccctgagtttaaatcctagctagcggctatataaccttgggcaagttacttaatctgctgtgccttatctataaaatggggataatgatagtgcttgcctcacagaattgttagaaaagtgaaataagttaatacatataaagcacttataataatacccgacacagtaagcacttaactactattattaatatcactactttttatttggaggctatgacttgaattatgagcctcacagagcaaacatatatatagctgttcagttgtcttaataggcaagaaagtaatttttgatccctttattctcttgaattccaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 190219 - DNA, 1038 bp, Homo sapiens
  Payload ID: 17566
  Gene Symbol: TEX30
  Gene Name: testis expressed 30
  ENST ID: ENST00000376021
  CDS Start-End: 187-747
gtcgcttcgagcgcgctagtcagctccctgaagggagtgacggcggttgggtgcccgcggccacttttgccttcccgggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 190220 - DNA, 828 bp, Homo sapiens
  Payload ID: 17566
  Gene Symbol: TEX30
  Gene Name: testis expressed 30
  ENST ID: ENST00000376022
  CDS Start-End: 183-401
cttcgagcgcgctagtcagctccctgaagggagtgacggcggttgggtgcccgcggccacttttgccttcccgggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 190221 - DNA, 1106 bp, Homo sapiens
  Payload ID: 17566
  Gene Symbol: TEX30
  Gene Name: testis expressed 30
  Uniprot ID: Q5JUR7
  ENST ID: ENST00000376027
  CDS Start-End: 218-559
tcatggatcttcagatcagctgttggtcagatgttggttagactagtctggactccagacttcagttttgggttcagttctgttccgtgtgtcttcattttgagacccaggctgaaaatgcaaaaccacctagagcatgtttttctcatggctgaggggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaaggtgcttttgtcttattgataggcaactgagaaattttgcagagcagcgttatcttcagaaaaggaaaacattatggttaatctagtcagagatttatagaatgcacacatctcttcacc

SEQ ID NO: 190222 - DNA, 959 bp, Homo sapiens
  Payload ID: 17566
  Gene Symbol: TEX30
  Gene Name: testis expressed 30
  Uniprot ID: Q5JUR7
  ENST ID: ENST00000376029
  CDS Start-End: 191-532
gcctgcgcgcgcgtgcgtcgtagccgaacgctgtggcggggcaggcgaggcggtcgcttcgagcgcgctagtcagctccctgaagggagtgacggcggttgggtgcccgcggccacttttgccttcccggggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 190223 - DNA, 1165 bp, Homo sapiens
  Payload ID: 17566
  Gene Symbol: TEX30
  Gene Name: testis expressed 30
  Uniprot ID: Q5JUR7
  ENST ID: ENST00000376032
  CDS Start-End: 191-874
gcctgcgcgcgcgtgcgtcgtagccgaacgctgtggcggggcaggcgaggcggtcgcttcgagcgcgctagtcagctccctgaagggagtgacggcggttgggtgcccgcggccacttttgccttcccggggagatgtcctttgcttctcagatgtaaatgcactttaagtttgttattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagcagcataaactcagagatgaagacctctttcgtttaaaagagcctgtactgtttgtgtcaggctcagcagatgaaatgtgtgaaaagaacttgttggagaaagtggcacagaaaatgcaagctccccataaaatccactggattgagaaggcaaatcattccatggcagtgaaaggacggtcgacaaatgatgttttcaaagaaataaatacacagattttgttttggatccaagaaattactgaaatggacaagaaatgtcattagttaaaagccatgttatcttgagtacacatacagttaatttgataaagaagagtatgcctctcagcattgtgagatatatttcagactaatttgatgttctttaatgttcccttatttttgaaacacgttttaaatgtgaaattaatgtccttcacaaaatgtcttttgaaagcactgttacagttgtataaagatgatgtaaaaatattgaaggtggtctacatataatttattttcattagtatagttaagttttgaaaaaaattaaacatctgaattttgttacaaaaa

SEQ ID NO: 190224 - DNA, 978 bp, Homo sapiens
  Payload ID: 17567
  Gene Symbol: TEX33
  Gene Name: testis expressed 33
  Uniprot ID: O43247
  ENST ID: ENST00000381821
  CDS Start-End: 113-955
atctgcacttctgggcttcagcacacatcagtgtggttcacgtgtttcctgctgttatgaaagagattggagaggactaagcttggaattgcctgtcccacagcaagaggctatggagctgggccacggagcaggtacaaccactttcaccagggcccatctgaatgacaaggagggccaacaggacttggacccctggaaagcggcctacagttccttggacacctccaagttcaagaaccagggtctgtcatccccacagcccctgcccctgggagccagcgctcaaggcagctccctagggcagtgccacttgaaggagattccccctccacccccgactgctgccagcagggattctctgggcatggacccacagtccaggtccctgaagaatgcgggctctcgatcctcctcgagagagaacagggccacctcgggagagggggctcagccatgccaggggacggatgacggtcccagcttgggggctcaggaccagaggagcacgcccacgaaccagaagggcagcatcattcctaacaacattcgccacaagtttgggagcaatgtggtggaccagctggtctccgaggagcaggctcaaaaggctattgatgaagtcttcgagggccagaaaagggcaagctcatggcccagcaggacccagaatcctgtggaaatctcctccgtcttctcagactactatgacctcggctacaacatgcggtcaaacttgtttcgaggggctgctgaggagacaaagagcctcatgaaggcttcttacacaccagaggtcattgagaaatcagtgagggacttagaacactggcatggcaggaagacggatgatctggggcggtggcaccagaaaaatgctatgaacctgaacttgcagaaagcactggaagagaaatatggagaaaacagcaaatccaagagctccaagtactagttttgacacagtagaggtgtctt

SEQ ID NO: 190225 - DNA, 986 bp, Homo sapiens
  Payload ID: 17567
  Gene Symbol: TEX33
  Gene Name: testis expressed 33
  Uniprot ID: O43247
  ENST ID: ENST00000402860
  CDS Start-End: 345-932
gcacttctgggcttcagcacacatcagtgtggttcacgtgtttcctgctgttatgaaagagattggagaggactaagcttggaattgcctgtcccacagcaagaggctatggagctgggccacggagcagggcccatctgaatgacaaggagggccaacaggacttggacccctggaaagcggcctacagttccttggacacctccaagttcaagaaccagggtctgtcatccccacagcccctgcccctgggagccagcgctcaaggcagctccctagggcagtgccacttgaaggagattccccctccacccccgactgctgccagcagggattctctgggcatggacccacagtccaggtccctgaagaatgcgggctctcgatcctcctcgagagagaacagggccacctcgggagagggggctcagccatgccaggggacggatgacggtcccagcttgggggctcaggaccagaggagcacgcccacgaaccagaagggcagcatcattcctaacaacattcgccacaagtttgggagcaatgtggtggaccagctggtctccgaggagcaggctcaaaaggctattgatgaagtcttcgagggccagaaaagggcaagctcatggcccagcaggacccagaatcctgtggaaatctcctccgtcttctcagactactatgacctcggctacaacatgcggtcaaacttgtttcgaggggctgctgaggagacaaagagcctcatgaaggcttcttacacaccagaggtcattgagaaatcagtgagggacttagaacactggcatggcaggaagacggatgatctggggcggtggcaccagaaaaatgctatgaacctgaacttgcagaaagcactggaagagaaatatggagaaaacagcaaatccaagagctccaagtactagttttgacacagtagaggtgtcttctactcaaataaagtgctaacaataaggaaa

SEQ ID NO: 190226 - DNA, 1149 bp, Homo sapiens
  Payload ID: 17567
  Gene Symbol: TEX33
  Gene Name: testis expressed 33
  Uniprot ID: O43247
  ENST ID: ENST00000405091
  CDS Start-End: 253-1095
aaccatccattggtcttcaccagtagttctgcagtggggatctgcacttctgggcttcagcacacatcagtgtggttcacgtgtttcctgctgttatgaaagagattggagaggtgagaaactggaagtgagtccacacttccattgtagcccgtccagactgctgtggactggcagtgcactgggacgtacagagctgccgtgggcacgtcaggactaagcttggaattgcctgtcccacagcaagaggctatggagctgggccacggagcaggtacaaccactttcaccagggcccatctgaatgacaaggagggccaacaggacttggacccctggaaagcggcctacagttccttggacacctccaagttcaagaaccagggtctgtcatccccacagcccctgcccctgggagccagcgctcaaggcagctccctagggcagtgccacttgaaggagattccccctccacccccgactgctgccagcagggattctctgggcatggacccacagtccaggtccctgaagaatgcgggctctcgatcctcctcgagagagaacagggccacctcgggagagggggctcagccatgccaggggacggatgacggtcccagcttgggggctcaggaccagaggagcacgcccacgaaccagaagggcagcatcattcctaacaacattcgccacaagtttgggagcaatgtggtggaccagctggtctccgaggagcaggctcaaaaggctattgatgaagtcttcgagggccagaaaagggcaagctcatggcccagcaggacccagaatcctgtggaaatctcctccgtcttctcagactactatgacctcggctacaacatgcggtcaaacttgtttcgaggggctgctgaggagacaaagagcctcatgaaggcttcttacacaccagaggtcattgagaaatcagtgagggacttagaacactggcatggcaggaagacggatgatctggggcggtggcaccagaaaaatgctatgaacctgaacttgcagaaagcactggaagagaaatatggagaaaacagcaaatccaagagctccaagtactagttttgacacagtagaggtgtcttctactcaaataaagtgctaacaataaggaaa

SEQ ID NO: 190227 - DNA, 477 bp, Homo sapiens
  Payload ID: 17567
  Gene Symbol: TEX33
  Gene Name: testis expressed 33
  ENST ID: ENST00000442538
  CDS Start-End: 1-418
caggacttggacccctggaaagcggcctacagttccttggacacctccaagttcaagaaccagggctcaaaaggctattgatgaagtcttcgagggccagaaaagggcaagctcatggcccagcaggacccagaatcctgtggaaatctcctccgtcttctcagactactatgacctcggctacaacatgcggtcaaacttgtttcgaggggctgctgaggagacaaagagcctcatgaaggcttcttacacaccagaggtcattgagaaatcagtgagggacttagaacactggcatggcaggaagacggatgatctggggcggtggcaccagaaaaatgctatgaacctgaacttgcagaaagcactggaagagaaatatggagaaaacagcaaatccaagagctccaagtactagttttgacacagtagaggtgtcttctactcaaataaagtgctaacaataaggaaaggctc

SEQ ID NO: 190228 - DNA, 1023 bp, Homo sapiens
  Payload ID: 17568
  Gene Symbol: TEX35
  Gene Name: testis expressed 35
  Uniprot ID: Q5T0J7
  ENST ID: ENST00000319416
  CDS Start-End: 113-814
acacaaaggggtggtcaccctgccctcaccttgacctgtaagttgcctaggacagtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgagaaatgtttgttgtgtgctctaaagaacaactacaatcgggggaacattccttcagaggcctcaggcctttacaaaggtggagaggagccagtgaccacccaaccttctgtgggccacgctgtgcctgccccaaagtcccagactgagggaaggtgaagcttaactgccagcttgaaatgagagtaaagaagatacagagcaaacagtgtttcagaaactgtcctgccctgggtgtgattctttggcttcaatttgaaggacgaggaatgatgggatttcatattttatttcacaccagttcctccttgtttcatctctttgctaagctggctgcttctaccatctaataaataattggccaagtt

SEQ ID NO: 190229 - DNA, 785 bp, Homo sapiens
  Payload ID: 17568
  Gene Symbol: TEX35
  Gene Name: testis expressed 35
  Uniprot ID: Q5T0J7
  ENST ID: ENST00000367639
  CDS Start-End: 46-693
aggggctgttgtggggagttgaagaacaccctggcctcctccatcatgtcggccaagagggcagaattgaagaaaacacatctggtaaaagagagacattgctggacaagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgagaaatgtttgttgtgtgctctaaagaacaactacaatcggggtatatacgctgcagtgggactgctggatctatggtagctcaatttttagttttttgaggaacaacctccaaactgttctccatagtggctgtactaatttacattcccaccaacagtgtacaaagattc

SEQ ID NO: 190230 - DNA, 2377 bp, Homo sapiens
  Payload ID: 17568
  Gene Symbol: TEX35
  Gene Name: testis expressed 35
  Uniprot ID: Q5T0J7
  ENST ID: ENST00000367641
  CDS Start-End: 60-665
agtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgtaagtgaaaccctgcccgagcccagcactggtgccagacccctggctccggctccctggtgacttccccgagcttgtgctgtatcatagtgaagggacaggtccgcccgctgctgacttctgggtgccgcccgagcctgcgccctccctgacctgccttgccttctaggcctgtggagcctccttagctgtgaccatgcaggacttgaccctggatgggcctacccgccagctccaccctcttattctgtccttccctttagcaagggcagataaggtgcctagcaggctgcccttcttggaccaggggaaattgatctttcttgtgccgtttctgtcctctgcaggagaaatgtttgttgtgtgctctaaagaacaactacaatcggggtaggtagattcatacaagatgtgccttttctcgatcaggtgccttgttgtccccaaggccatgtgctcccagccgcattcacatcacacccctcctgaggttgtgccaggagtagggactgttagcagatgctgccacccagcatgctcagtcatacaggatgtggcaccaggaaggaggacttgggtcacccagcctagaggctgctgcctggggctcccatggtggggagggtgcaccactagtggcggaactgaccttgcctcaggtcctgccctttctccccatccagtgggaaatattcacaccaggtctgggcacccttttcacccttggcttctggagctgccttctgatttatctgtacctcaaccccggtgacatcgaatatgtgtttccaacctagcgcagctgcagaacctaccagcagttccgattcatcacctccaagctccttaagatgcacagtcagggcttcttgtcctgttaaataccaccccaaccccaggcctccactggagattaaaaaccttcattcaaagccaaaggggatgtcatggttttgagtaccagtccaaaacttgagtgtgtggaggttgattatttttggttctatatcagtgtatttcagactccaacccttccccctgcttcctgatggattggtgggaaattacatcttagtcatcttagggtcctcccaaccaccacctccctccattccacctgggtctgcaaacgtcccaggtcatagcatggggagggcccctgatgatagcggacgccagtctgtgtggtctcaggagagaccctgctgcctggcccatccgctccctccacataatcagcctccacctgtgcatggggccagggtgtcttgggtgatgcagggaacccctcagcctcgagttctgcctgcaccacacccctctgaggtcttgtcaccaagcaggactcaggtccctgctgctcataggaactgggtagctttcttgggttctggggatccacccttctcacccccttgaaggtttcctctccctccctccacccccaaagggaacattccttcagaggcctcaggcctttacaaaggtggagaggagccagtgaccacccaaccttctgtgggccacgctgtgcctgccccaaagtcccagactgagggaaggtgaagcttaactgccagcttgaaatgagagtaaagaagatacagagcaaacagtgtttcagaaactgtcctgccctgggtgtgattctttggcttcaatttgaaggacgaggaatgatgggatttcatattttatttcacaccagttcctccttgtttcatctctttgctaagctggctgcttctaccatctaataaataattggccaagtt

SEQ ID NO: 190231 - DNA, 2452 bp, Homo sapiens
  Payload ID: 17568
  Gene Symbol: TEX35
  Gene Name: testis expressed 35
  ENST ID: ENST00000367642
  CDS Start-End: 72-371
gttgcctaggacagtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaagtaagaagcccttttgaggccatgcaggcagccaggcctgagatccatggggaagtgaccaggagtcaggggtcatttgctgatcctagtggccaagatttgtcccagacatttgattacaaagcagttaaacaagaagggcggtttaccaaagcaggaaggacacccagactcttggaggagttgtctttgctcctactgcccctgtgacttggagtcaaggccttccatggccacccgtgtactggttatctccttgtcatgctgcaaaatgtctccccaactctctgcccctccctggccctcctcccccagtccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgtaagtgaaaccctgcccgagcccagcactggtgccagacccctggctccggctccctggtgacttccccgagcttgtgctgtatcatagtgaagggacaggtccgcccgctgctgacttctgggtgccgcccgagcctgcgccctccctgacctgccttgccttctaggcctgtggagcctccttagctgtgaccatgcaggacttgaccctggatgggcctacccgccagctccaccctcttattctgtccttccctttagcaagggcagataaggtgcctagcaggctgcccttcttggaccaggggaaattgatctttcttgtgccgtttctgtcctctgcaggagaaatgtttgttgtgtgctctaaagaacaactacaatcggggtaggtagattcatacaagatgtgccttttctcgatcaggtgccttgttgtccccaaggccatgtgctcccagccgcattcacatcacacccctcctgaggttgtgccaggagtagggactgttagcagatgctgccacccagcatgctcagtcatacaggatgtggcaccaggaaggaggacttgggtcacccagcctagaggctgctgcctggggctcccatggtggggagggtgcaccactagtggcggaactgaccttgcctcaggtcctgccctttctccccatccagtgggaaatattcacaccaggtctgggcacccttttcacccttggcttctggagctgccttctgatttatctgtacctcaaccccggtgacatcgaatatgtgtttccaacctagcgcagctgcagaacctaccagcagttccgattcatcacctccaagctccttaagatgcacagtcagggcttcttgtcctgttaaataccaccccaaccccaggcctccactggagattaaaaaccttcattcaaagccaaaggggatgtcatggttttgagtaccagtccaaaacttgagtgtgtggaggttgattatttttggttctatatcagtgtatttcagactccaacccttccccctgcttcctgatggattggtgggaaattacatcttagtcatcttagggtcctcccaaccaccacctccctccattccacctgggtctgcaaacgtcccaggtcatagcatggggagggcccctgatgatagcggacgccagtctgtgtggtctcaggagagaccctgctgcctggcccatccgctccctccacataatcagcctccacctgtgcatggggccagggtgtcttgggtgatgcagggaacccctcagcctcgagttctgcctgcaccacacccctctgaggtcttgtcaccaagcaggactcaggtccctgctgctcataggaactgggtagctttcttgggttctggggatccacccttctcacccccttgaaggtttcctctccctccctccacccccaaagggaacattccttcagaggcctcaggcctttacaaaggtggagaggagccagtgaccacccaaccttctgtgggccacgctgtgcctgccccaaagtcccagactgagggaaggtgaagcttaactgccagcttgaaatgagagtaaagaagatacagagcaaacagtgtttcagaaactgtcctgccctgggtgtgattctttggcttcaatttgaaggacgaggaatgatgggatttcatattttatttcacaccagttcctccttgtttcatctctttgctaagctggctgcttctaccatctaataaataattggccaagt

SEQ ID NO: 190232 - DNA, 802 bp, Homo sapiens
  Payload ID: 17568
  Gene Symbol: TEX35
  Gene Name: testis expressed 35
  Uniprot ID: Q5T0J7
  ENST ID: ENST00000367643
  CDS Start-End: 78-716
ctgtaagttgcctaggacagtggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgagaaatgtttgttgtgtgctctaaagaacaactacaatcgggcgcagctgcagaacctaccagcagttccgattcatcacctccaagctccttaagatgcacagtcagggcttcttgtcctgttaaataccaccccaaccccaggcctccactggagattaaaaaccttcattcaaagcca

SEQ ID NO: 190233 - DNA, 344 bp, Homo sapiens
  Payload ID: 17568
  Gene Symbol: TEX35
  Gene Name: testis expressed 35
  ENST ID: ENST00000442872
  CDS Start-End: 1-153
aaaacagggctcactggatccccttcatcactgtgggacctgctgcgagaaatgtttgttgtgtgctctaaagaacaactacaatcgggtgggaaatattcacaccaggtctgggcacccttttcacccttggcttctggagctgccttctgatttatctgtacctcaaccccggtgacatcgaatatgtgtttccaacctagcgcagctgcagaacctaccagcagttccgattcatcacctccaagctccttaagatgcacagtcagggcttcttgtcctgttaaataccaccccaaccccaggcctccactggagattaaaaaccttcattcaaagccaaa

SEQ ID NO: 190234 - DNA, 1832 bp, Homo sapiens
  Payload ID: 17568
  Gene Symbol: TEX35
  Gene Name: testis expressed 35
  ENST ID: ENST00000419909
  CDS Start-End: 57-323
ggcctggtcccaggggctgttgtggggagttgaagaacaccctggcctcctccatcatgtcggccaagagggcagaattgaagaaaacacatctgagcaagaactacaaggcagtttgcctggaattgaagccagagccgaccaaaacatttgattacaaagcagttaaacaagaagggcggtttaccaaagcaggagtgacacaggacctaaagaatgaactcagggaagtgagagaagagctcaaggagaaaatggaggagataaaacagccatgcctttcttccttgttagataaaggatctaatggacaaggattttgataaacttcacgaatttgtggaaattatgaaggaaatgcagaaagatatggatgagaagatggacattttaataaatacacagaagaactataagcttccccttagaagagcaccaaaggagcagcaggaactcaggctgatgggaaagactcacagagaaccacagctcaggcccaagaaaatggatggagccagtggagtcaatggagcaccctgtgctcttcacaagaagacgatggcaccacaaaaaacaaaacagggctcactggatccccttcatcactgtgggacctgctgcgagaaatgtttgttgtgtgctctaaagaacaactacaatcgggctgctcccctaaaggaagctcgtcacctcctgacagccaattctattgacccttctgcagctcttgttcttctgattgagttcctgcttttgaccctggtaacaggtgcggcagccccaggccttgacgcatgtggtcatcagagaaacatgagggatgaaataaactcagagagaaggtaatgagcataatctgtctgaggtcacaggatacgtggcagagctgaaattcgaatcctagcattctgacttcagaacctgtttcctggacactctggcttctctcgatgtggtccccggcccggcagcatcagcactgtctgggagcttgtgggaggtgcagcatctcaggctctaccccagacctactgaatcagaatctgcattttcacaatacttcctggggtcagagaaaaggaataggggaaggacagtgtggagaagagagagaaaggaagggagacaagtaggagcgagaggactggagagaaaaagaagctgggtttcaatcccatcatgaggcggagatctcaccacgttgccttggccggtctccaaccccttgtgagctcaagtgatcctcccacctcggcctcccaaagtgctgtgattataggtgtgagcccttacacccagcctgtttgcatcttttaatgagtacccaaattaacctctaattgggacttgattttctacaagtgctgctccaagaggcttctacacccccgcagggaggcaagcaccgttttgaggtggccgggctggcgaggagattgggggcaggagctgctttttcaatgagaagaatgaacagacctagtgggcgttgcctttagacccaggatgtaaaaggtaatgccagcagacgttggcagtgctggagacacctggtgggcagaggttacctggctggagtggcaggtgtgaggagatgcctcccagcataaggaatgtgggcttctgttggatctcttgttccaggcctcacacatgttcaaggcagcctgggtatgtcttggcccattcaatccctcaaagccctgtttaattctcatcttgctgtcacctatgtggtgccaagaaacaagtcaccaaaataatgaaatgcctacctaagcttaaaaacaaaaccatgaggtctttctaaataaattatgaaaaagtgcaaa

SEQ ID NO: 190235 - DNA, 922 bp, Homo sapiens
  Payload ID: 17569
  Gene Symbol: TEX36
  Gene Name: testis expressed 36
  Uniprot ID: Q5VZQ5
  ENST ID: ENST00000368821
  CDS Start-End: 156-716
ggaagaggctgagaagtaaagatcaggaacaaggaggaggaggagcttcccagacgtgtagagcttatgaagtttaggaagcagcttcccagacatgtagagcttatggagaggtgagggagccaatctcagccacattcagcttcctggagagaatgaccaaagggcgacgcttcaacccaccttcagacaaggatgggagatggttccctcacatcgggctaacgcaaaagacaccagaatccatcaccagtgctacgtcaaaagagccccagagtccacacttgcctcggcaagcggaggggaagctgccgcccatatacaaagtccgggagaagcaagcagtgaataaccagttccccttctccgtgcatgacaatcggcacagcttggagaactctggatgctaccttgactccggcctgggacgtaagaagatctctccagataagaggcaacatgtttcaagaaattttaatctctgggcatgtgactatgttccatcttgtcttgatggcttttcaaataaccaaatatcatacgtatataaagaagccatggtggtctcaagcttcagacgctttccacgatgctataaagagatatggaacgcttttacatttcttcctgagagaagctatacagaggttttgaaaaagaagcccaaagtaaggttcactgttgacaaaaaggttgtttcttcactggagtcctaatcctcccagaagatttttgatgaattttgtaatactggtatttcatcagacatcctaaaagtatatgttttctgatccagcaccactatttaatttttaaagtacttttatgatttttataaggtcaaaaaacattcaaatccttgtgaaatgaatttgtgatgacatacgcatgtgtaaataaacttttcagatggccacattta

SEQ ID NO: 190236 - DNA, 734 bp, Homo sapiens
  Payload ID: 17569
  Gene Symbol: TEX36
  Gene Name: testis expressed 36
  ENST ID: ENST00000532135
  CDS Start-End: 118-507
ggaggagcttcccagacgtgtagagcttatgaagtttaggaagcagcttcccagacatgtagagcttatggagaggtgagggagccaatctcagccacattcagcttcctggagagaatgaccaaagggcgacgcttcaacccaccttcagacaaggatgggagatggttccctcacatcgggctaacgcaaaagacaccagaatccatcaccagtgctacgtcaaaagagccccagagtccacacttgcctcggcaagcggaggggaagctgccgcccatatacaaagtccgggagaagcaagcagtgaataaccagttccccttctccgtgcatgacaatcggcacagcttggagaactctggatgctaccttgactccgaaagaatgacagcaacggacccacagggagaaccagacaagagacaagagttctatgagccggtgaggacccagtccattcctcatccaggcctgagaactaatgcacccctccttgcagtgtgagctctttgggagcaagtttctgtcacccattccccagagtcctgactaatagaatgtgtattagttgggaagaaaaggaccttttgtcttagcctagctagttagtaaccaccaggatttattcagcattcttggaaaaataaatttccagctatggagaaatcctcttattctgcttgcctgtgtgggcgcaggtattaatagggctatctccctggcaggaagaa

SEQ ID NO: 190237 - DNA, 438 bp, Homo sapiens
  Payload ID: 17569
  Gene Symbol: TEX36
  Gene Name: testis expressed 36
  ENST ID: ENST00000526819
  CDS Start-End: 142-438
agtaaagatcaggaacaaggaggaggaggagcttcccagacgtgtagagcttatgaagtttaggaagcagcttcccagacatgtagagcttatggagaggtgagggagccaatctcagccacattcagcttcctggagagaatgaccaaagggcgacgcttcaacccaccttcagacaaggatgggagatggttccctcacatcgggctaacgcaaaagacaccagaatccatcaccagtgctacgtcaaaagagccccagagtccacacttgcctcggcaagcggaggggaagctgccgcccatatacaaagtccgggagaagcaagcagtgaataaccagttccccttctccgtgcatgacaatcggcacagcttggagaactctggatgctaccttgactcctttgcagatggcctatcgtgggacttctctttg

SEQ ID NO: 190238 - DNA, 795 bp, Homo sapiens
  Payload ID: 17570
  Gene Symbol: TEX37
  Gene Name: testis expressed 37
  Uniprot ID: Q96LM6
  ENST ID: ENST00000303254
  CDS Start-End: 143-685
agcaacaggactctccatgtggcaagggcacctggaggtgggagggcaggagcgtcgtcttgccctggcagaagaagcggtaggctctgtctgcgtggcagctggtccccagccctaggagagaagctgtctgtcgtttgccatggcaggtgtgaaatacccgggacaggaccctgtggatttagacatataccaaagctcccacatggtcgactatcagccctacaggaagcacaaatactccagggtcacgccgcaagagcaggcaaagctcgatgctcaactccgggacaaagagttttacaggcccatccctaaccccaaccccaagctaacagatgggtaccctgctttcaaaagaccccacatgactgccaaagacctgggactccccggcttcttcccatcacaggaacatgaggccacgagggaggacgagcgcaagttcaccagcacctgccatttcacatatccagcttcccacgatctgcacctggcccagggtgaccccaaccaggtcctccagagtgctgactttccgtgcctcgtggatcccaaacaccagcctgctgcagagatggccaaaggctacctgctactgccagggtgtccctgtcttcattgccatatagtcaaggtccccatcttgaaccggtggggacccttgatgccattttaccagtaggaaggatgaaaataccttccaaaggctcttccaagggcatgtggaaatcctatgaccttggagtgcagagaggagaactgaaaataaaactggaaagatgttccaactgc

SEQ ID NO: 190239 - DNA, 866 bp, Homo sapiens
  Payload ID: 17571
  Gene Symbol: TEX38
  Gene Name: testis expressed 38
  Uniprot ID: Q6PEX7
  ENST ID: ENST00000334122
  CDS Start-End: 108-728
attctggagactctgattggctgggcagatgggctgactggctgggcagatgggtgggtgagttccctctccccagagccatcggccaggtaccaaagctcagctgtatggattcccaacaggaggacctgcgcttccctgggatgtgggtctcattgtactttggaatcctggggctgtgttctgtgataactggagggtgcattatctttctgcactggaggaagaacttgaggcgggaagagcatgcccagcagtgggtggaggtgatgagagctgccacattcacctacagcccattgttgtactggattaacaagcgacggcgctacggcatgaatgcagccatcaacacgggccctgcccctgctgtcaccaagactgagactgaggtccagaatccagatgttctgtgggatttggacatccccgaaggcaggagccatgctgaccaagacagcaaccccaaggcggaagcccctgctcccctgcaacctgcactgcagctggctccacagcagccccaggccagatccccattcccacttcccatctttcaggaggtgccctttgccccacccttgtgcaacctaccccccctgctgaaccactctgtctcctatcctttggccacctgtcctgaaaggaatgttctcttccattccctcctgaatctggcccaggaagaccatagcttcaatgccaagccttttccttcagaactgtagcctcctctcactgaaggtgggagctgcaggaatcaggtgcagagtaggaaatggaactaacctcaggaaggtggtattgacagaggtcaggacccacctggatgtcatgctatgaaacattaaaagaaaaaaaaaaaa

SEQ ID NO: 190240 - DNA, 637 bp, Homo sapiens
  Payload ID: 17571
  Gene Symbol: TEX38
  Gene Name: testis expressed 38
  ENST ID: ENST00000564373
  CDS Start-End: 141-599
tgggtgggtgagttccctctccccagagccatcggccaggtaccaaagctcagctgtatggattcccaacaggaggacctgcgcttccctgggagaagaacttgaggcgggaagagcatgcccagcagtgggtggaggtgatgagagctgccacattcacctacagcccattgttgtactggattaacaagcgacggcgctacggcatgaatgcagccatcaacacgggccctgcccctgctgtcaccaagactgagactgaggtccagaatccagatgttctgtgggatttggacatccccgaaggcaggagccatgctgaccaagacagcaaccccaaggcggaagcccctgctcccctgcaacctgcactgcagctggctccacagcagccccaggccagatccccattcccacttcccatctttcaggaggtgccctttgccccacccttgtgcaacctaccccccctgctgaaccactctgtctcctatcctttggccacctgtcctgaaaggaatgttctcttccattccctcctgaatctggcccaggaagaccatagcttcaatgccaagccttttccttcagaactgtagcctcctctcactgaaggtgggagctgcaggaatcaggt

SEQ ID NO: 190241 - DNA, 566 bp, Homo sapiens
  Payload ID: 17571
  Gene Symbol: TEX38
  Gene Name: testis expressed 38
  ENST ID: ENST00000415500
  CDS Start-End: 154-546
ggctgactggctgggcagatgggtgggtgagttccctctccccagagccatcggccaggtaccaaagctcagctgtatggattcccaacaggaggacctgcgcttccctgggacccattgttgtactggattaacaagcgacggcgctacggcatgaatgcagccatcaacacgggccctgcccctgctgtcaccaagactgagactgaggtccagaatccagatgttctgtgggatttggacatccccgaaggcaggagccatgctgaccaagacagcaaccccaaggcggaagcccctgctcccctgcaacctgcactgcagctggctccacagcagccccaggccagatccccattcccacttcccatctttcaggaggtgccctttgccccacccttgtgcaacctaccccccctgctgaaccactctgtctcctatcctttggccacctgtcctgaaaggaatgttctcttccattccctcctgaatctggcccaggaagaccatagcttcaatgccaagccttttccttcagaactgtagcctcctctcactgaaggtgg

SEQ ID NO: 190242 - DNA, 1003 bp, Homo sapiens
  Payload ID: 17571
  Gene Symbol: TEX38
  Gene Name: testis expressed 38
  ENST ID: ENST00000564071
  CDS Start-End: 585-1003
cgagagtaattatgtgacttgttcaagttctacccgacagctgagctcttttcaagatggcagctgcctcccaagcctccttttcctctgcttcctgacatcctccttgaactccagccacagtgacctattctctcccaaagaaacaccaggattactccttgaagagtccttattcaggccctttttgacccctggaatcctctctccttccattctctcaacccaaatgccacaatcttccttaccgtctgaaccaggtgtgagctcctagggtcagggacagtgacattaacatctctgtgtcccacctgctcacagaacagggccagtcctggagtgggctctctgggacagtactcatcatcaggtccttcttgtctgggttttgtctgattgaagcccctcctgggacaggggcagagccttcaactctgctcaatccaacctatgctcatggagatcagccctgagccctgccctgtgcgaggaacagtgtaatggaagatgaataagtccttcaagtatgccagcccatacctggctcacactcctaacacttgctgttttctctgtggatctgcatgtggctgcctcctcatcatctaagggctcagttcacattgtgggtctcattgtactttggaatcctggggctgtgttctgtgataactggagggtgcattatctttctgcactggaggaagaacttgaggcgggaagagcatgcccagcagtgggtggaggtgatgagagctgccacattcacctacagcccattgttgtactggattaacaagcgacggcgctacggcatgaatgcagccatcaacacgggccctgcccctgctgtcaccaagactgagactgaggtccagaatccagatgttctgtgggatttggacatccccgaaggcaggagccatgctgaccaagacagcaaccccaaggcggaagcccctgctcccctgcaacctgcactgcagctggctccacagcagcc

SEQ ID NO: 190243 - DNA, 917 bp, Homo sapiens
  Payload ID: 17572
  Gene Symbol: TEX40
  Gene Name: testis expressed 40
  ENST ID: ENST00000539943
  CDS Start-End: 317-793
taggccccttaccctgtccgctccaacccacccttggtccgactcgggcccctggcgctatttcttactcagccttggctgcccgcagcccccacccaaccccacgttctacgggatccccaacccggcccggctcagttccccagcccgctcttccttcccgctccagccatccgcgacccttggctccctccttgtatgtggcccacaggtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccgaaaagtcttcctcaatgtcatcactcaatattgcgaagcacatgccccatcgagcctactgggcagagcagcagagcaggctgccactgcccctgatggaactcatggagaatgaagctctggaaatcctcaccaaagccctccggagctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgcatgg

SEQ ID NO: 190244 - DNA, 464 bp, Homo sapiens
  Payload ID: 17573
  Gene Symbol: TEX43
  Gene Name: testis expressed 43
  Uniprot ID: Q6ZNM6
  ENST ID: ENST00000357147
  CDS Start-End: 14-418
attgctgtcaggaatggcttcagggaaagatacttgtcctactttgcctaaactcactaacaactgctctgatgagagtctctataaatctgctaataagtatgaagagattcatttgccacgattttcattaaagcaagggatgatcccaagacgttatgtcatgccttggaaagaaaacatgatattcaggaatgtgaatctgaagcaagcagaagtgtgtgggatccatactggccctttagaagactctctgtttttgaatcacagtgaaaggctttgccatggggaagatcgtaaagttgtcttccaaaaaggcccaccagaaataaaaattgcagatatgcctttgcattcgcctctctccagataccaaagcactgtgatttcccatggcttcaggaggcgactagtctaatgaaagaagaataaaataataaagtgtttcaatctctgctctctta

SEQ ID NO: 190245 - DNA, 1433 bp, Homo sapiens
  Payload ID: 17574
  Gene Symbol: TEX9
  Gene Name: testis expressed 9
  Uniprot ID: Q8N6V9
  ENST ID: ENST00000352903
  CDS Start-End: 25-1200
gtaaccgcgtcgcagtcgccgaagatggcggggcgaagtctgtgtctcacgagaagcagcgttccagggactccgttcccgccacccgttcagcaaccctctacacctggacccgacctcctcgccttggaggaagaatataagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagacagcagcgaacaattaatatgcaacagtctcaagtagaaaaatacaaaactcttttcgaagaagcaaacaaaaagtatgatggattacagcaacagttgtcttcagtagaaagggaattagaaaataaaagaagactgcaaaaacaggctgcaagtagtcaaagtgccacagaggttcgcttgaatagagctctagaagaagcagaaaagtataaactggagttaagtaaattaaggcaaaataacaaggacatagcaaatgaagaacacaaaaaaattgaagtgttaaaatcagaaaacaagaagctagaaaaacaaaaaggagaattaatgatagggttcaagaaacagttaaaattaattgatgttttaaaaaggcaaaagatgcatattgaagctgccaagatgctatctttcactgaggaggaatttatgaaagcacttgaatggggaaattcataagtgatctacttcagttagtctctatgacaataagaaaactaaggctcagagaaaaagccaaaactagtacttgcatgacacctagtcaagtcctagtagtattcgactttcattttgtggatcaatttttatttggaaaatagcagcaattctcgtaggagtcagattaaaacgtctacaactaccttgaataacttcaactatcaggataattaaaactgcaaaccactgga

SEQ ID NO: 190246 - DNA, 1768 bp, Homo sapiens
  Payload ID: 17574
  Gene Symbol: TEX9
  Gene Name: testis expressed 9
  Uniprot ID: Q8N6V9
  ENST ID: ENST00000537232
  CDS Start-End: 462-1412
gcagtcgccgaagatggcggggcgaagtctgtgtctcacgagaagcagcgttccagggactccgttcccgccacccgttcagcaaccctctacacctggacccgacctcctcgccttggaggaagaatataagtaagaaattcggcggttgaacttttccttctttctttcatctgaatgaggctgcttacaagtacttttttctggagactggctggatcttcgggaccactcactctgcagcattcccttctcgtcatctcgttcacctgccgtttatcctttctttgtctttgatctgagtagttcgcctgcgtattagaagatatttgaagtgggcgaaaatttagcccaagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagacagcagcgaacaattaatatgcaacagtctcaagtagaaaaatacaaaactcttttcgaagaagcaaacaaaaagtatgatggattacagcaacagttgtcttcagtagaaagggaattagaaaataaaagaagactgcaaaaacaggctgcaagtagtcaaagtgccacagaggttcgcttgaatagagctctagaagaagcagaaaagtataaactggagttaagtaaattaaggcaaaataacaaggacatagcaaatgaagaacacaaaaaaattgaagtgttaaaatcagaaaacaagaagctagaaaaacaaaaaggagaattaatgatagggttcaagaaacagttaaaattaattgatgttttaaaaaggcaaaagatgcatattgaagctgccaagatgctatctttcactgaggaggaatttatgaaagcacttgaatggggaaattcataagtgatctacttcagttagtctctatgacaataagaaaactaaggctcagagaaaaagccaaaactagtacttgcatgacacctagtcaagtcctagtagtattcgactttcattttgtggatcaatttttatttggaaaatagcagcaattctcgtaggagtcagattaaaacgtctacaactaccttgaataacttcaactatcaggataattaaaactgcaaaccactggacaaacaggacattgtttgtgctactttctttttcaaaggacagcgctatatggcttagcaaatgaagtctctccaccttttcttatcacctgccacacctaaaggtattcctgttaacagcat

SEQ ID NO: 190247 - DNA, 689 bp, Homo sapiens
  Payload ID: 17574
  Gene Symbol: TEX9
  Gene Name: testis expressed 9
  ENST ID: ENST00000560827
  CDS Start-End: 377-689
ggccagggaagcgcgccgctgggggccgggaggagtccggcccggctggtggagagcaggaaaacgtgggggaggtgctggcgagagaaagagaacttgcgtgaggaggaggaggagaaaccaaatttaataatatttggcgtggaaatgggatttgggcgggggaggcatcttcaaagcaagtaaagagaaatcaacattatcccccttcccctgcacatgcatgtgaggattacttcctccctgagtaaatgaagagaactgaagcaggcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgata

SEQ ID NO: 190248 - DNA, 4440 bp, Homo sapiens
  Payload ID: 17574
  Gene Symbol: TEX9
  Gene Name: testis expressed 9
  ENST ID: ENST00000558083
  CDS Start-End: 331-957
gaagatggcggggcgaagtctgtgtctcacggtcagttcaactccaggctcctggggagcgtctgggttccggcgactaggacgcctaacttcctttaacttcgggtctgaaagtctgtggctcttttacagagaagcagcgttccagggactccgttcccgccacccgttcagcaaccctctacacctggacccgacctcctcgccttggaggaagaatataagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagacagcagcgaacaattaatatgcaacagtctcaagtagaaaaatacaaaactcttttcgaagaagcaaacaaaaagtatgatggattacagcaacagttgtcttcagtagaaagggtaattatttggtatttttcctaacttaatgccacagatacaagaaaattattaaggttacacatttgtatagatgccattttgacagttcagttattttattagtatttactgaaaactctttccccttacatagaatatttttaacaactttattgagatgtaattcacccttttaaagtatgcaattcaatggcttttggtgtattcatagaattgtgcaactatcaccacaaccattttcataatccctaaaagatacttcataccctttagccaccacaccctgaccctgctcccctcaatcccttacagccctaggcaaccactattctattttatgtctcaataaatttgtctattctggaaatcacatatacgtggaatcatataatatgtggtcttttgtgactgacttttacttaagatattttcaaggttcattcatgttgcagcccctatcagtattttatttctttttattggcaagtaacattctgttatatggatataacacatttaatttatctgtttatcagttcgtagctttaggttatttgggttgtttctactgtctgacaattttaaatactttgaatattcatgtacaagtttttgtgtgcacgtatgtttctatttctcttggttatatagccaggaatggaattgctgggtcatatggaaatcctatgttgaccttttgaggaattgctgactgttttccaacctgcctgtaccattttacattcctaccagtagtgcatgaagctcctaatttctacacatcctcaccaacatctgctagattatctttttgattatagccatactgcaagtgtaaaagggttacctcattgtggttttgatttgcatttccctaataactaatgatgttgaacatcttttcatgtgcttattggcatttgtatattttctttggagaaatgtctgttaaggtctttgcccattttttaaattggatttgaaaaaattactgaataataagaacttttaagttctttatgtgtttagatacaagtcccttatcaggtatattttgcaaatagttttcccctacagtgggttgtctttcactttctttatggtactctaaaggcacaaaagttttaaattttgatgaagtccagtttatctaatatttatttggtttcctgtgcttttggtgtcatatttaaggggagaatgtattttaaataaactatcctagcttatattagtgtgccattgtgaaaataaaaatatactgtttgagattgctttgtaaaatgtagtgacgataagaattatgtaatatagcatatcccgagatttagtaagaaaatgtgccccctttattagtacccttacatttctcgtttgtatggtcatatttaaaaaccctgctttttaaacattttggtcttgtataattagctttatcttgtaataaattttaatatcaaaatcacttagacaaaatttatatgcagtaaattcacactttttagtgtacaattctatgagttttgacaaatgtatgcagtaatataactatcactataattgagacatagaacagttccatcagccccccaaaattccctgtgaatttagtgaaggccttccctaattccaccaccaggcaaccactgatctgtgtttggttcttaaattttggacttttcccaaatgtcacataaatagaatcgcattggatatagacttttgaatctgttttttttttttttttttcagttagcataaaacatttgatatggtttggctgtgtccccacccaaatttcatcttgaattcccacttgttgcgggagggagccggtgggaggtaattgaatcatgggggcaagtctttcctgtgctgttcttgtgatggcgaaaaagtctcaggagatctgatggttttaaaagggagagtttcccagtgcaaactttcttgtctgctgctatgtgagacatgccttttactttccaacatgattgtgaggcctccccagccatgtggaactgtgagtccaataaacctctctcttttgtaaattgcccagtcttgggtgtgtcttaccagcagcatgacgatgaactaatccagtaaattggtactagtagagtcaggcgctactgaaaagataccaaaaagtgttgaagtgaccttggaactgggtaagaggcagaggttggaaaagtttggagggctcagaaaaatacaggaaaatatgggaaagtttggaactccctagagacttgttgaatggctttgaccaatatactgataatgatatggacaatgaaatccaggctgaggtgatctcagatggagatgaggaacttgttaggaactagagcaaatgtgactcttgttatgttttagcaaagagactggtggcattttgtccctcccctagagatctgtggaactttgaacttgagagagatgatttagggtatctggtggaacaaatttctaagcagcaaagcactcaagaggtgacttggtgctgttaaaggcatccagttttgaaagggaaacagagcacaaaaggttggaaaatttgcagcctgagaatgcagtggaaaagaaaatcccattttctgaggagaaattcaagccggctgcagaaatttgcataagtcttgaggagctgaatgttaatccccaggacaatggggaaaatgtctcccaaggtatgcagaggtcttcacggcagcgcctcccatcacaggcccagagacctaggaggcatgattggttttgaaatgtgaggacatgagatttgggagggtcttggggtagaatatggtttggctgtgtccccacccaaatttcatcttgaattcccatgtgttgtgggagggacccagtgggaggtcattgaatcacaggggcaggtctttcctgtgctgttctcatgagagtgaataagtctcaggagatttgatggttttaaaaatgggaatttccctgcacaagctctcgtctgccaccatgtgagatgtgcctttaccttccagcatgattgtgaggcctccccagccatgtgaaactgtgagtgcagtaaatctctttcttttgtaaattgcccagtcttgggtatgtctttatcagcagcatgaaaacggactaatacaacattcaatatttatccctattatagtccattcctttttattgctgagtagtgtaaactatgaatgaatgtacttcagtttgtttccccactcatctagtaataaaagttaattatagtatttaatagtctgaacttgtgtttccagtatggtagccacttaccatatgtggctaaattgcgatgtgctataactataaagtaaaaatcagattttgaagaattcatgtaaaacagaatgaagaatgtaaaatatctcaaaatctctttaatattttttgtattggttatatgttgaaataatatttgaatatattaggttaagtgaaatatgttattaaaattaattttacctgtttgtt

SEQ ID NO: 190249 - DNA, 687 bp, Homo sapiens
  Payload ID: 17574
  Gene Symbol: TEX9
  Gene Name: testis expressed 9
  ENST ID: ENST00000558127
  CDS Start-End: 5-244
gaagatggcggggcgaagtctgtgtctcacggtcagttcaactccaggctcctggggagcgtctgggttccggcgactaggacgcctaacttcctttaacttcgggtctgaaagtctgtggctcttttacagagaagcagcgttccagggactccgttcccgccacccgttcagcaaccctctacacctggacccgacctcctcgccttggaggaagaatataagtaagaaattcggcggttgaacttttccttctttctttcatctgaatgaggctgcttacaagtacttttttctggagactggctggatcttcgggaccactcactctgcagcattcccttctcgtcatctcgttcacctgccgtttatcctttctttgtctttgatctgagtagttcgcctgcgtattagaagatatttgaagtgggcgaaaatttagcccaagcgtttaaatgcagaattgcaggcaaaaacagctgacgtggttcaacaagctaaggaaataatatgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacag

SEQ ID NO: 190250 - DNA, 2005 bp, Homo sapiens
  Payload ID: 17574
  Gene Symbol: TEX9
  Gene Name: testis expressed 9
  ENST ID: ENST00000560582
  CDS Start-End: 19-327
cagcagcgaacaattaatatgcaacagtctcaagtagaaaaatacaaaactcttttcgaagaagcaaacaaaaagtatgatggattacagcaacagttgtcttcagtagaaagggaattagaaaataaaagaagactgcaaaaacaggctgcaagtagtcaaagtgccacagaggttcgcttgaatagagctctagaagaagcagaaaagtataaactggagttaagtaaattaaggcaaaataacaagatgcatattgaagctgccaagatgctatctttcactgaggaggaatttatgaaagcacttgaatggggaaattcataagtgatctacttcagttagtctctatgacagtatgtgatggatacccattttacttattgtagtggtttgaattatttttattcttcataagtaatatatttgattatgaaagcaaaataatttcaaagaattccctttttagatttaggagattagctattagctctttttgagttgttttttaagttcttagcgtgacaattaagcacatcagataataaaattcttgactcttttcatttataattctcctcccttacagtagaccaaaaaagatgctttaaaagaaaattccaaatatttatttccctggctaaatcaagtaagtaaagttcgtaaacacagacagaaggcagttcactttggggtagagttctgtattagtcaaggtaaatatactgtcttgaggatggggatgcaaacagtgctctgtagtgttgtagaaatcggattttgaaattatcagtacaaaaataacagcttgattaaaattaatttgtatctgataattgtttacaagttatgaaattcagtgatgatttacaaaatccaaacagacaatggatacctaatgccactgaactgtaaaacaaaagttatgctgacatctagtggtaacatgcaaaaaatctatgctttacccaattttgatgatatcatttctcttcacaaatttcactcctttgttgatatactttcctgaactcttcaccaagcagatcaatatcatcctcttttttaaatactccctacgagaaaaatactttgtgggttacttttgaataccagaatatttcactaaatgcttttaagactgacagacataagattagtaaagttatctccaaggtaatgaaatctattcaacagattaatgaaactttaaaaaaatcaatacttttcaaaaaataagactttacatatatattgaatattcctagactgacccaattttctgatttatcagctctagtgtaggagcttttcataggaatctgagctcttctacaagttctactgcttggattacctagataggaaggcacttcatctatactgtaccctacccttttctttaaatagctctataatatgatataatggtgagcttcagtagattcatgcatgggattagttcttcatgcctcagttctatggctaatcagcaaacagtcaatcttgcagaaaagaatccaggtttggagttaagccatttaagcaaaccctttggaattcttcactgttctatttttcttttcccctacagtatactgcaaaaggctctttaaaacaaaattaaatatttacttaaattgcaatctaaagaataaagaattttagggataactgaagtcatttggcaccattaggacctaaaggataaaggtcatttttggatatcaagtttattaatccctcctgctgcctccacaattatttcctctacaaaaatatcaaatcccaaagaaagacattcctacaatttataatttagtttatgaaatgtattaattacatatggattttatcattaatacatcattttgtattccttaatcctttctaaccaattagactatcaagtcctgtggccaggcagtaattacctatatatctttttccttccttagcaccagagtgaatataataaaataaatatgcacttgattctactgaa

SEQ ID NO: 190251 - DNA, 2297 bp, Homo sapiens
  Payload ID: 17574
  Gene Symbol: TEX9
  Gene Name: testis expressed 9
  ENST ID: ENST00000561221
  CDS Start-End: 6-857
cgaagatggcggggcgaagtctgtgtctcacgagaagcagcgttccagggactccgttcccgccacccgttcagcaaccctctacacctggacccgacctcctcgccttggaggaagaatataagcgtttaaatgcagaattgcaggcaaaaacagctgacgtggttcaacaagctaaggaaataataagagatcggcaagaagtacgatctaggcctgtttcaacacaaatgaaatcatgtgatgacgaagatgattacagtttaagaggtctgttaccatctgaagggatagttcatcttcattcagaaactaagccaaagaccaaaaacattgatcctgtaaacaaggttcaaaacaaattacactctgcaaataaaggaaggaaaacaaattcaagtgttaaattgaaatactctgatgtccaaactgccgacgatgttgccattccagaggatttctcagacttttcccttgcaaaaacaattagcaaaattgaagggcaactggaggaagaaggcttacctgaatatatagatgatattttttctggtgttagtaatgacattggaacagaagcacagatcagatttctaaaggccaaactccatgttatgcaggaggaattggataatgttgtatgtgaatgcaataaaaaggaggatgaaattcagaatttaaagtctcaagtaaaaaattttgaagaagattttatgagacagcagcgaacaattaatatgcaacagtctcaagtagaaaaatacaaaactcttttcgaagaagcaaacaaaaagtatgatggattacagcaacagttgtcttcagtagaaagggtaattatttggtatttttcctaacttaatgccacagatacaagaaaattattaaggttacacatttgtatagatgccattttgacagttcagttattttattagtatttactgaaaactctttccccttacatagaatatttttaacaactttattgagatgtaattcacccttttaaagtatgcaattcaatggcttttggtgtattcatagaattgtgcaactatcaccacaaccattttcataatccctaaaagatacttcataccctttagccaccacaccctgaccctgctcccctcaatcccttacagccctaggcaaccactattctattttatgtctcaataaatttgtctattctggaaatcacatatacgtggaatcatataatatgtggtcttttgtgactgacttttacttaagatattttcaaggttcattcatgttgcagcccctatcagtattttatttctttttattggcaagtaacattctgttatatggatataacacatttaatttatctgtttatcagttcgtagctttaggttatttgggttgtttctactgtctgacaattttaaatactttgaatattcatgtacaagtttttgtgtgcacgtatgtttctatttctcttggttatatagccaggaatggaattgctgggtcatatggaaatcctatgttgaccttttgaggaattgctgactgttttccaacctgcctgtaccattttacattcctaccagtagtgcatgaagctcctaatttctacacatcctcaccaacatctgctagattatctttttgattatagccatactgcaagtgtaaaagggttacctcattgtggttttgatttgcatttccctaataactaatgatgttgaacatcttttcatgtgcttattggcatttgtatattttctttggagaaatgtctgttaaggtctttgcccattttttaaattggatttgaaaaaattactgaataataagaacttttaagttctttatgtgtttagatacaagtcccttatcaggtatattttgcaaatagttttcccctacagtgggttgtctttcactttctttatggtactctaaaggcacaaaagttttaaattttgatgaagtccagtttatctaatatttatttggtttcctgtgcttttggtgtcatatttaaggggagaatgtattttaaataaactatcctagcttatattagtgtgccattgtgaaaataaaaatatactgtttgagattgctttgtaaaatgtagtgacgataagaattatgtaatatagcatatcccgagatttagtaagaaaatgtgccccctttattagtacccttacatttctcgtttgtatggtcatatttaaaaaccctgctttttaaacattttggtcttgtataattagctttatcttgtaataaattttaatatcaaa

SEQ ID NO: 190252 - DNA, 1171 bp, Homo sapiens
  Payload ID: 17575
  Gene Symbol: TSPY1
  Gene Name: testis specific protein, Y-linked 1
  Uniprot ID: Q01534
  ENST ID: ENST00000423647
  CDS Start-End: 47-931
ggcccttcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcaccggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtgggagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagtcccctgacagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 190253 - DNA, 1160 bp, Homo sapiens
  Payload ID: 17575
  Gene Symbol: TSPY1
  Gene Name: testis specific protein, Y-linked 1
  Uniprot ID: Q01534
  ENST ID: ENST00000451548
  CDS Start-End: 47-973
ggcccttcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcaccggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtgggagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 190254 - DNA, 854 bp, Homo sapiens
  Payload ID: 17575
  Gene Symbol: TSPY1
  Gene Name: testis specific protein, Y-linked 1
  ENST ID: ENST00000440483
  CDS Start-End: 1-666
atgcgccctgagggctcgctgacctaccgggtgccagagaggctgcggcagggtttctgtggcgtgggtcgggcagcacaggccttggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtgggagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagga

SEQ ID NO: 190255 - DNA, 1161 bp, Homo sapiens
  Payload ID: 17575
  Gene Symbol: TSPY1
  Gene Name: testis specific protein, Y-linked 1
  ENST ID: ENST00000446779
  CDS Start-End: 47-973
ggcccttcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcaccggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagga

SEQ ID NO: 190256 - DNA, 1125 bp, Homo sapiens
  Payload ID: 17576
  Gene Symbol: TSPY10
  Gene Name: testis specific protein, Y-linked 10
  ENST ID: ENST00000444056
  CDS Start-End: 1-885
atgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagtcccctgacagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaacagatcgagtcacaaaaattcaggaagagggggtaaatgtggattgtatggaatgaaaaataaacattctcaagg

SEQ ID NO: 190257 - DNA, 1161 bp, Homo sapiens
  Payload ID: 17576
  Gene Symbol: TSPY10
  Gene Name: testis specific protein, Y-linked 10
  ENST ID: ENST00000428845
  CDS Start-End: 47-973
ggcccttcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaacagatcgagtcacaaaaattcaggaagagggggtaaatgtggattgtatggaatgaaaaataaacattctcaagga

SEQ ID NO: 190258 - DNA, 1161 bp, Homo sapiens
  Payload ID: 17577
  Gene Symbol: TSPY2
  Gene Name: testis specific protein, Y-linked 2
  Uniprot ID: A6NKD2
  ENST ID: ENST00000320701
  CDS Start-End: 47-973
ggctcttcgcgcgcagtcccttagggggcgcctggaagcccggcgcatgcgccctgagggctcgctgacctaccgggtgccagagaggctgcggcagggttcctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcgtgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacagcagtactcagcatggtcttatgcacaggaactaaaggaaaaagagatcgagtcacaaaaattcaggaagagggggtaaatgtggattgtatggaatgaaaaataaacattctcaagga

SEQ ID NO: 190259 - DNA, 1125 bp, Homo sapiens
  Payload ID: 17577
  Gene Symbol: TSPY2
  Gene Name: testis specific protein, Y-linked 2
  ENST ID: ENST00000383042
  CDS Start-End: 1-885
atgcgccctgagggctcgctgacctaccgggtgccagagaggctgcggcagggttcctgtggcgtgggtcgggcagcacaggccttggtgtgtgcgagtgccaaggagggcaccgccttcaggatggaggctgtgcaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcgtgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagtcccctgacagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacagcagtactcagcatggtcttatgcacaggaactaaaggaaaaagagatcgagtcacaaaaattcaggaagagggggtaaatgtggattgtatggaatgaaaaataaacattctcaagg

SEQ ID NO: 190260 - DNA, 779 bp, Homo sapiens
  Payload ID: 17577
  Gene Symbol: TSPY2
  Gene Name: testis specific protein, Y-linked 2
  ENST ID: ENST00000429039
  CDS Start-End: 47-712
ggctcttcgcgcgcagtcccttagggggcgcctggaagcccggcgcatgcgccctgagggctcgctgacctaccgggtgccagagaggctgcggcagggttcctgtggcgtgggtcgggcagcacaggccttggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcgtgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcagga

SEQ ID NO: 190261 - DNA, 1161 bp, Homo sapiens
  Payload ID: 17578
  Gene Symbol: TSPY3
  Gene Name: testis specific protein, Y-linked 3
  Uniprot ID: P0CV98
  ENST ID: ENST00000457222
  CDS Start-End: 47-973
ggcccttcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcgtatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagga

SEQ ID NO: 190262 - DNA, 1125 bp, Homo sapiens
  Payload ID: 17578
  Gene Symbol: TSPY3
  Gene Name: testis specific protein, Y-linked 3
  ENST ID: ENST00000424594
  CDS Start-End: 1-885
atgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcgtatcgccgcagacaccacaacagcagccttaacttcttcaactggttctctgaccacaacttcgcaggatctaacaagattgctgagtcccctgacagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 190263 - DNA, 1143 bp, Homo sapiens
  Payload ID: 17579
  Gene Symbol: TSPY4
  Gene Name: testis specific protein, Y-linked 4
  ENST ID: ENST00000383008
  CDS Start-End: 1-903
atgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagtcccctgacagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 190264 - DNA, 1179 bp, Homo sapiens
  Payload ID: 17579
  Gene Symbol: TSPY4
  Gene Name: testis specific protein, Y-linked 4
  Uniprot ID: P0CV99
  ENST ID: ENST00000426950
  CDS Start-End: 47-991
ggcccttcgcgcgcagtcccttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagga

SEQ ID NO: 190265 - DNA, 1161 bp, Homo sapiens
  Payload ID: 17580
  Gene Symbol: TSPY8
  Gene Name: testis specific protein, Y-linked 8
  Uniprot ID: P0CW00
  ENST ID: ENST00000287721
  CDS Start-End: 47-973
ggcccttcgcgcgcagtcccttagggggcgcctggaagcccggcgcatgcgccctgagggctcgctgacctactgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatctggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagga

SEQ ID NO: 190266 - DNA, 1125 bp, Homo sapiens
  Payload ID: 17580
  Gene Symbol: TSPY8
  Gene Name: testis specific protein, Y-linked 8
  ENST ID: ENST00000383000
  CDS Start-End: 1-885
atgcgccctgagggctcgctgacctactgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatctggattatgaagtggaggcctatcgccgcagacaccacaacagcagccttaacttcttcaactggttctctgaccacaacttcgcaggatctaacaagattgctgagtcccctgacagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 190267 - DNA, 1160 bp, Homo sapiens
  Payload ID: 17580
  Gene Name: testis specific protein, Y-linked 8
  ENST ID: ENST00000383005
  CDS Start-End: 47-973
ggcccttcgcgcgcagtcccttagggggcgcctggaagcccggcgcatgcgccctgagggctcgctgacctactgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccacctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagg

SEQ ID NO: 190268 - DNA, 1160 bp, Homo sapiens
  Payload ID: 17581
  Gene Name: testis specific protein, Y-linked 9, pseudogene
  ENST ID: ENST00000440215
  CDS Start-End: 28-972
cttagggggcgcctggaagcccggcgcatgcgccctgagggctcgctgacctaccgggtgccagagaggctgcggcagggtttctgtggcgtgggtcgggcagcacaggccttggtgtgtgcgagtgccaaggagggcaccgccttcaggatggaggctgtacaggagggggcggccggggtggagagtgagcaggcggctttgggggaggaggcggtgctgctgttggatgacataatggcggaggtggaggtggtggcggaggtggaggtggtggcggaggaggagggcctcgtggagcggcgggaggaggcccagcgggcacagcaggctgtgcctggccctgggcccatgaccccagagtctgcactggaggagctgctggccgttcaggtggagctggagccggttaatgcccaagccaggaaggccttttctcggcagcgggaaaagatggagcggaggcgcaagccccagctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaagga

SEQ ID NO: 190269 - DNA, 3037 bp, Homo sapiens
  Payload ID: 17582
  Gene Name: testis specific, 10
  Uniprot ID: Q9BZW7
  ENST ID: ENST00000355053
  CDS Start-End: 630-2726
gggcgtgcgcctgcgcggcgcggatgggccaggaaggggtccctcctaggtgccctgtaaggcaggcaggtagacgtacgcgtcgctccgtgcgtaggagcgcgcgcacggcttgtagaccccgcgagaaggaaggtcgagccaggttaccaccaaagaatatgattttggtctaggggctccagtttctgaagctgaaaactaccagaatactctccagctagaacaagaagtgagaaaccaagatagattcatctcgacactgaaattacagattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaa

SEQ ID NO: 190270 - DNA, 2460 bp, Homo sapiens
  Payload ID: 17582
  Gene Name: testis specific, 10
  ENST ID: ENST00000393482
  CDS Start-End: 389-2460
gcgcaccgggcctgggggcgagcgggacggaagcaaagctggggcgccggggaggtggaagacgagccccactccggttaccaccaaagaatatgattttggtctaggggctccagtttctgaagctgaaaactaccagaatactctccagctagaacaagaagtgagaaaccaagatagattcatctcgacactgaaattacagattgatctcatttgccagcaaaataatattatagtattggaagatacaataaaaaggcttaaatctataattttagatactgaaaaagcacaaaataaatctccttctagacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaaga

SEQ ID NO: 190271 - DNA, 3878 bp, Homo sapiens
  Payload ID: 17582
  Gene Name: testis specific, 10
  Uniprot ID: Q9BZW7
  ENST ID: ENST00000393483
  CDS Start-End: 846-2942
agaaggaggggcgcgcagggatcgcgcctagtctctccgcctgcggagccgtggggtcccggcagcccgcaggagtgctaagtaagggtccttcagggcgggaaccaggttccaggcagggacgcaggctacgttcgaataaaagtaccgaaggtcataaggccccagttcagatgggacttccccgcgtgacagcacagagataacggccagccctgggcgaaggttaccaccaaagaatatgattttggtctaggggctccagtttctgaagctgaaaactaccagaatactctccagctagaacaagaagtgagaaaccaagatagattcatctcgacactgaaattacaggcatttggatacctttgtgatagaaaaggcccttttcttcatccattgatggtttgatagtgggctgggaaggaaagctgtgttcctccacattaggcagcaaatacttgattgatttgatatttagcttagtcaaattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaagtgtttttacaaaactgctttcctttcctttcttggtatctcaaataattggttggttaattttttttctttgtgatttgtgttttcatggctggaaaatctgtgccaaaatgggtacaacttactgatactggtctgggatctgatattccattttggaaccaaccttacatgaattccatgccataatctgatattgaagcagcagaaagtaggagtgttgtcagggttttaaaacctatagtattgtaccactcaaagactaagtaacatacatattctacaattgtgtttactactactgcttttagaaaggtaggtgatggtatatctgtcaagaatgtaagattttattaaaaatctttatttttaataagttttctttcaagtactgcaatcaacttaattgcgattttattttattgtctgtggcagctgtctgtaatctggagtaataagataagtgatgtttccttcctcccccaatttcctaaatctcttaccttatctatccataggctttgatgtaatgttcatattagagcctgaatgctactgtattttactgatataaactatttgtattcttgccattttaataaaaaaaggcttgtcattaatagta

SEQ ID NO: 190272 - DNA, 2390 bp, Homo sapiens
  Payload ID: 17582
  Gene Name: testis specific, 10
  ENST ID: ENST00000409564
  CDS Start-End: 529-2390
gttaccaccaaagaatatgattttggtctaggggctccagtttctgaagctgaaaactaccagaatactctccagctagaacaagaagtgagaaaccaagatagattcatctcgacactgaaattacagattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctataattttagatactgaaaaagcacaaaataaatctccttctagacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaaagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaaga

SEQ ID NO: 190273 - DNA, 3036 bp, Homo sapiens
  Payload ID: 17582
  Gene Name: testis specific, 10
  Uniprot ID: Q9BZW7
  ENST ID: ENST00000410001
  CDS Start-End: 629-2725
caggtatctaacctatctttgtatttttggaatttaatatagttcctgacataatcattgttcaatgggtctaattttttttttcctttaaaggcatttggatacctttgtgatagaaaaggcccttttcttcatccattgatggtttgatagtgggctgggaaggaaagctgtgttcctccacattaggcagcaaatacttgattgatttgatatttagcttagtcaaattgaagatctcaaacagacaaatcatggcttggaagaatatgttaggaaactcttggatagtaaggaggtggtaagcagtcaagtagatgatttaaccagccacaatgagcatctttgtaaagaattgattaaaattgaccaactagcagagcaactcgaaaaagagaaaaattttgtggtggattccgccaacaaggaacttgaagaagccaagattgatctcatttgccagcaaaataatattatagtattggaagatacaataaaaaggcttaaatctataattttagatactgaaaaagcacaaaataaatctccttctagacttgattcctttgtcaagactttggaagcagacaaagatcactataagagtgaagctcaacatttgagaaagatgatgcgaagtaggtctaaaagtccaagacgcccatcaccaactgcccggggtgcaaactgtgatgtagaacttttgaagacaacaacaagagatcgtgaagaacttaaatgcatgctggaaaaatatgagcgccatttggcagaaattcagggtaatgtcaaggttcttaaatctgagagagacaagatcttccttctttatgaacaggcacaggaagaaattacccgacttcgacgagaaatgatgaaaagctgtaagagtcctaaatcaacaacggcacatgctattctccggcgagtggagactgaaagagatgtagcctttactgatttacgaagaatgaccacagaacgagatagtctaagggagaggctaaagattgctcaagagacagcatttaatgagaaggctcacctggaacaaaggatagaggagctggagtgtacagttcataatcttgatgatgaacgtatggagcaaatgtcaaatatgactttgatgaaggaaaccataagcactgtggaaaaagaaatgaaatcactagcaagaaaggcaatggataccgaaagtgaacttggcagacaaaaagcagagaataattctttgagacttttgtatgaaaacacagaaaaagatctttctgatactcagcgacaccttgctaagaaaaaatatgagctacagcttactcaggagaaaattatgtgcttggatgaaaaaattgataactttacaaggcaaaatattgcacagcgagaagaaatcagcattcttggtggaaccctcaatgatctggctaaagaaaaggaatgcctgcaagcatgtttggataaaaaatctgagaatattgcatcccttggagagagtttggcaatgaaagaaaagaccatttcaggcatgaagaatatcattgctgagatggaacaggcatcaagacagtgtactgaggccctaattgtgtgtgaacaagacgtttccagaatgcgtcggcaattggatgagacaaatgatgagctggcccagatcgccagggaaagagatatcttggctcatgacaatgacaatctccaggaacagtttgctaaagctaaacaagaaaaccaggcactgtccaaaaaattgaatgacactcataatgaacttaatgacataaaacagaaggttcaagatactaatttggaggttaacaagctgaagaatatattaaagtctgaagaatctgagaaccggcaaatgatggaacaacttcgaaaagccaatgaagatgctgaaaactgggaaaataaagcccgtcaatcagaggcagataacaataccctcaaactggaacttatcactgctgaggcagagggtaacagattaaaagaaaaagtagattccctcaacagagaggttgagcaacacttaaatgcagaaaggtcttacaagtcccagatttctaccttacataaatctgttgtaaaaatggaagaggagcttcagaaggttcagtttgaaaaagtgtccgctcttgcagatttgtcttctactagggaactctgtattaaacttgactcaagcaaagaacttcttaatcgacagctggttgctaaagatcaagaaatagaaatgagggagaatgagttagattctgctcattctgaaattgaactcctgaggagtcagatggcaaatgagagaatctccatgcagaatctagaagctttgctggtggccaatcgagacaaagaatatcagtctcagatagcacttcaagaaaaagaatctgaaattcagcttcttaaagaacacctttgtttggcagaaaataaaatggccatccagagtagagatgtggcccagttcagaaatgttgtcacacaattggaagctgatttagacattaccaaaagacaactaggaacagagcgctttgaaagggagagggccgtacaagaacttcgccgccaaaattattcaagtaatgcttatcatatgagttctacaatgaagccaaatacaaaatgtcattcaccagaacgtgctcaccatcgatctcctgaccgaggcctagatcgatcattagaagagaatctttgctacagagatttctgacacctgaaatgattcttcacatccctgagaaaggtcaaagttacaaactgatttttttttttttgctacatgagtgcatttatcttttaaatgcttggcaatgttaaatgtatttattaactttgtgtctctgaatctctgttctaatgtgccatgttgcagtgatctgagatgacttataaaaacaaaaatgtatatggctctttctatccatgcagtgatagtgagtgtaaaatctgcttacttcactattgaacactattctgttcactatctggagtaaataaagaagcttattaaaacagggaaaa

SEQ ID NO: 190274 - DNA, 1589 bp, Homo sapiens
  Payload ID: 17583
  Gene Name: testis specific, 10 interacting protein
  Uniprot ID: Q3SY00
  ENST ID: ENST00000608857
  CDS Start-End: 33-1244
agttctacggtgcggatgggggatggggcaggatggggcaggacaccgatatgctaaatacctaccaacagttggttaggaccccgtcggtgcgaccagggcaggacgtgcggctccaggctccaggaaccagaacggggctgctcaagctgctgtcgaccgtctctcaggacaagcagggctgcctggggagtggtgatggtgtgccaaatcaagacctgcagcagaggtctcagagctcaaggcagacagcaaagaaggaccgcaagcccaggggccagagcaagaaaggacagggctctgaagagtctgaagatcacttcccgcttcttcctcggaaaccctccttccccttccagtgggcctgggagagcatcgccacagatgtccgggctgtgcttcagccaagctccccaacccctggccaccaagccctgcccatgccctcctcgttctcccagcgtcagtccaggcgcaagtccacggccaacctcccagaggcccatggctgctgctggaagacagaggcgcaaaacctgaaggcgagacagcagctgggagcctggggcggtgtctccatccctactggcaaaggggagctaggatcagagccccccagtggtctccagctgcctgggaggaggccaggatcaggatcggcgtccgacaagcaggtccagctgcaaagcctgggtgctgaggaggccgagaggggtctgagttctggggtgctgccccagcgccccaggagggggtcgatctcagaggaggagcaattttcagaggccacagaggaggctgaggagggagagcacaggactccctgcagaaggagggctggttgtcagagaaaggggcagatttctggagaggaagcctccgatgagggagaagtgcagggccagagccaggggagcagccccagcttcaacaacctccgaaggcgacaatggaggaagacaagggccaaggagctgcaggggccatgggacctggagaagctgcacaggcagctacagagagacctggactgtggaagccaccaggagcctgctgcaggcctgggagcggcagcggcaggaggagcggcagcaggccgagctgcggcgggcccggacacagcatgtacagcggcaggtggcccactgcctggcagcctacgcacccagagggagccggggccctggggcggcccagcgcaagctggaggagctgaggcgccaggagcgacagcgctttgctgagtaccaggcggagctgcaaggcatccagcacagggtgcaggcccggcccttcctgttccagcaggctatgcaggccaatgcccggctcaccgtcactcggcgcttctcccaggtgctgtcagcactggggctggatgaggagcagctgctgtctgaggcaggaaaggtggacagagagggcacccccaggaaacccaggagccacaggtcaatgggggtgagaatggagcactctcctcagaggcccccaaggacagaacccaccggcagccagcctgacaggcactacaaccccagcctggacccggagtgcagtccctgagataaaattaaaggctttatggc

SEQ ID NO: 190275 - DNA, 722 bp, Homo sapiens
  Payload ID: 17583
  Gene Name: testis specific, 10 interacting protein
  ENST ID: ENST00000534740
  CDS Start-End: 33-377
agttctacggtgcggatgggggatggggcaggatggggcaggacaccgatatgctaaatacctaccaacagttggttaggaccccgtcggtgcgaccagggcaggacgtgcggctccaggctccaggaaccagaacggggctgctcaagctgctgtcgaccgtctctcaggacaagcaggagcctgctgcaggcctgggagcggcagcggcaggaggagcggcagcaggccgagctgcggcgggcccggacacagcatgtacagcggcaggtggcccactgcctggcagcctacgcacccagagggagccggggccctggggcggcccagcgcaagctggaggagctgaggcgccaggagcgacagcgctttgctgagtaccaggcggagctgcaaggcatccagcacagggtgcaggcccggcccttcctgttccagcaggctatgcaggccaatgcccggctcaccgtcactcggcgcttctcccaggtgctgtcagcactggggctggatgaggagcagctgctgtctgaggcaggaaaggtggacagagagggcacccccaggaaacccaggagccacaggtcaatgggggtgagaatggagcactctcctcagaggcccccaaggacagaacccaccggcagccagcctgacaggcactacaaccccagcctggacccggagtgcagtccctgagataaaattaaaggctttatggc

SEQ ID NO: 190276 - DNA, 563 bp, Homo sapiens
  Payload ID: 17583
  Gene Name: testis specific, 10 interacting protein
  ENST ID: ENST00000528291
  CDS Start-End: 1-150
gatatgctaaatacctaccaacagttggttaggaccccgtcggtgcgaccagggcaggacgtgcggctccaggctccaggaaccagaacggggctgctcaagctgctgtcgaccgtctctcaggacaagcaggtgagggaggcccagtgaggacacttccagctgcctagagccagggctgcctggggagtggtgatggtgtgccaaatcaagacctgcagcagaggtctcagagctcaaggcagacagcaaagaaggaccgcaagcccaggggccagagcaagaaaggacagggctctgaagagtctgaagatcacttcccgcttcttcctcggaaaccctccttccccttccagtgggcctgggagagcatcgccacagatgtccgggctgtgcttcagccaagctccccaacccctggccaccaagccctgcccatgccctcctcgttctcccagcgtcagtccaggcgcaagtccacggccaacctcccagaggcccatggctgctgctggaagacagaggcgcaaaacctgaaggcgagacagcagctgggagcctgg

SEQ ID NO: 190277 - DNA, 1925 bp, Homo sapiens
  Payload ID: 17583
  Gene Name: testis specific, 10 interacting protein
  Uniprot ID: Q3SY00
  ENST ID: ENST00000532620
  CDS Start-End: 232-1902
acacggggagcctgtggatgaggcagaggcaggacttgggcctgggtctctgcgctaaatgactcctgggcatcctgctgaactctctcccagaaggagattggcctcacataccccactgaccccttcctagcatgctttttgccagacccattgagactggctgaggactggttgccatagagatggcctgttaggcagttctacggtgcggatgggggatggggcaggatggggcaggacaccgatatgctaaatacctaccaacagttggttaggaccccgtcggtgcgaccagggcaggacgtgcggctccaggctccaggaaccagaacggggctgctcaagctgctgtcgaccgtctctcaggacaagcagggctgcctggggagtggtgatggtgtgccaaatcaagacctgcagcagaggtctcagagctcaaggcagacagcaaagaaggaccgcaagcccaggggccagagcaagaaaggacagggctctgaagagtctgaagatcacttcccgcttcttcctcggaaaccctccttccccttccagtgggcctgggagagcatcgccacagatgtccgggctgtgcttcagccaagctccccaacccctggccaccaagccctgcccatgccctcctcgttctcccagcgtcagtccaggcgcaagtccacggccaacctcccagaggcccatggctgctgctggaagacagaggcgcaaaacctgaaggcgagacagcagctgggagcctggggcggtgtctccatccctactggcaaaggggagctaggatcagagccccccagtggtctccagctgcctgggaggaggccaggatcaggatcggcgtccgacaagcaggtccagctgcaaagcctgggtgctgaggaggccgagaggggtctgagttctggggtgctgccccagcgccccaggagggggtcgatctcagaggaggagcaattttcagaggccacagaggaggctgaggagggagagcacaggactccctgcagaaggagggctggttgtcagagaaaggggcagatttctggagaggaagcctccgatgagggagaagtgcagggccagagccaggggagcagccccagcttcaacaacctccgaaggcgacaatggaggaagacaagggccaaggagctgcaggggccatgggacctggagaagctgcacaggcagctacagagagacctggactgtggcccccaaaagctgccctggaagactttgagggctgccttccaggcctccaagcggaatggaaaggcctatgcctcgggatacgatgaaactttcgtgtctgccaacctccctaatcgcaccttccacaaacgacaggaagccaccaggagcctgctgcaggcctgggagcggcagcggcaggaggagcggcagcaggccgagctgcggcgggcccggacacagcatgtacagcggcaggtggcccactgcctggcagcctacgcacccagagggagccggggccctggggcggcccagcgcaagctggaggagctgaggcgccaggagcgacagcgctttgctgagtaccaggcggagctgcaaggcatccagcacagggtgcaggcccggcccttcctgttccagcaggctatgcaggccaatgcccggctcaccgtcactcggcgcttctcccaggtgctgtcagcactggggctggatgaggagcagctgctgtctgaggcaggaaaggtggacagagagggcacccccaggaaacccaggagccacaggtcaatgggggtgagaatggagcactctcctcagaggcccccaaggacagaacccaccggcagccagcctgacaggcactacaaccccagcctggacccggagtgcagtccctgagataaaattaaaggctttatggc

SEQ ID NO: 190278 - DNA, 1372 bp, Homo sapiens
  Payload ID: 17584
  Gene Name: testis specific, 13
  Uniprot ID: Q96PP4
  ENST ID: ENST00000356588
  CDS Start-End: 458-1285
cacaaattccctctgtctcctccagaatccagaaaagaataattacgatattttcaaaatggaaagttcccatgccaaagactttgccttcttcaccaaactatgatttcgtgatgttcttaaaggtagtgtacaccaggtttttacattcttattttgaatgtagttttagtgtttgtgtgatttgtttttcagcctggcctgcagactagcaacccaagacttatactgcccaatttgacagctcatttttattttagtttcaccatatacatgaattggacttacaattccagaaaaattaaaggctcaagaatggggcatgagtacacactgtgtgctaaggaaagaatatttggattgaattgaacccctgcagaacgtggactatttagagacctgaatttggccttgggtgaatacctgccttgggttggccaactagcagtcaacagcaatgagccaaaagagacaaaccaagtttcaaaatggcaaatcaaagacttcagaaaatagctcagctaaacgtgagaaaggaatggttgtcaatagcaaagagatttctgatgcagtcgggcaatcaaaatttgttctagagaaccttcggcattacacagtccatccaaatttggcccagtactataagcctttgaaggccactgccctgcagaaattcctggctcaaaacaggaaaaacaccagcttcatgttaaaagtaacacagtatgaccaggataagacgttactgattatgaccaacaacccacctccctgctcaatcacccagcaagacaaggagagtgcatcaaaatatttttccaaggagttactgctcaaggtcatggaaagtcatcatcagcacaaacccactgagaacctctggctgccccgcatgcctcagaaaaaaaagttaagatctaagctgaaaccaatcttccctttgatactgtcggatgatcccacatccaagcgagaacaatggtttaggttttccactgacaatgatttcaagagcgaagggaagtattcaaaagtctacgctttgaggacacagaagaaaatgtaccctcagctcacctttgctccagtccatgagagagatatgaggaaagatgcttccaagaagtcagcgagtgaaaggccaatttccaaagtgattcgggaaccactgacactcgcatcgctcttggaagacatgcccaccagaaccgcgcccggggagagcgccttccgcaacgggagggccccgcagtggattatcaaaaaggccacggtcatcgggtgaacacagacccctcagtcctcccgcctcgctctcttgagactgaggggtccgcagaagtcgccacccaaataaaaccacattcctgct

SEQ ID NO: 190279 - DNA, 2046 bp, Homo sapiens
  Payload ID: 17584
  Gene Name: testis specific, 13
  Uniprot ID: Q96PP4
  ENST ID: ENST00000456951
  CDS Start-End: 853-1680
gaatgcataagatacaaagcactgggaggggggcacaaatatgtttaaaatttacatttccacttttaagggactcacagcttaagaggcagacaagacccgcacataagaaaagtgaaaacagaactacaagacactatacaatgacatgcacaaaacccagtgactatagtctagagtttgggattgcattaatctagaaaatcttctctttaaaggaatgacctgagtagtaacataaagaaagaagattcagggctgggcatggtggctcacgcctgtaatcccagcactttgggaggctgaggtgggtggatcacaaggtcaagagatcgagaccatcctggccaacatggtgaaaccccgtctctactaaaaatacaaaaattagctgggcatggtggcaggcgcctgtagtcccagctactctggaggctgaggcaggaaaatcacttgaaccagggagacagaggttgcagtgaactgagactgtgccactgcactccagccttgtgacagtgtgaggctccgtcagaagaaagagaaggagaaggagaaggagaagattcaaatggctgaagagattggggacagcattttaaaatccagaaaagaataattacgatattttcaaaatggaaagttcccatgccaaagactttgccttcttcaccaaactatgatttcgtgatgttcttaaaggctcaagaatggggcatgagtacacactgtgtgctaaggaaagaatatttggattgaattgaacccctgcagaacgtggactatttagagacctgaatttggccttgggtgaatacctgccttgggttggccaactagcagtcaacagcaatgagccaaaagagacaaaccaagtttcaaaatggcaaatcaaagacttcagaaaatagctcagctaaacgtgagaaaggaatggttgtcaatagcaaagagatttctgatgcagtcgggcaatcaaaatttgttctagagaaccttcggcattacacagtccatccaaatttggcccagtactataagcctttgaaggccactgccctgcagaaattcctggctcaaaacaggaaaaacaccagcttcatgttaaaagtaacacagtatgaccaggataagacgttactgattatgaccaacaacccacctccctgctcaatcacccagcaagacaaggagagtgcatcaaaatatttttccaaggagttactgctcaaggtcatggaaagtcatcatcagcacaaacccactgagaacctctggctgccccgcatgcctcagaaaaaaaagttaagatctaagctgaaaccaatcttccctttgatactgtcggatgatcccacatccaagcgagaacaatggtttaggttttccactgacaatgatttcaagagcgaagggaagtattcaaaagtctacgctttgaggacacagaagaaaatgtaccctcagctcacctttgctccagtccatgagagagatatgaggaaagatgcttccaagaagtcagcgagtgaaaggccaatttccaaagtgattcgggaaccactgacactcgcatcgctcttggaagacatgcccaccagaaccgcgcccggggagagcgccttccgcaacgggagggccccgcagtggattatcaaaaaggccacggtcatcgggtgaacacagacccctcagtcctcccgcctcgctctcttgagactgaggggtccgcagaagtcgccacccaaataaaaccacattcctgctgctgcgggcgtgggctcccgggtcgcaagccgggagggtcgagccgaagtctccggcgggccgcaagaggagaagggggcgtggctgcgtcccgggggccgagggcggccggggagggcgggccttggccccgagtgaaggcgcggcggcccaaccggcgtgagagcgcggggccggccttcctgcagcctcttccgctcgccggctgcggcgcctgggacggttgcggtgggtctgggcgctgggaagtcgtccaagatgattaaaaaattcgacaag

SEQ ID NO: 190280 - DNA, 567 bp, Homo sapiens
  Payload ID: 17584
  Gene Name: testis specific, 13
  ENST ID: ENST00000438346
  CDS Start-End: 394-567
attcatcacaaattccctctgtctcctccagaatccagaaaagaataattacgatattttcaaaatggaaagttcccatgccaaagactttgccttcttcaccaaactatgatttcgtgatgttcttaaagcctggcctgcagactagcaacccaagacttatactgcccaatttgacagctcatttttattttagtttcaccatatacatgaattggacttacaattccagaaaaattaaaggctcaagaatggggcatgagtacacactgtgtgctaaggaaagaatatttggattgaattgaacccctgcagaacgtggactatttagagacctgaatttggccttgggtgaatacctgccttgggttggccaactagcagtcaacagcaatgagccaaaagagacaaaccaagtttcaaaatggcaaatcaaagacttcagaaaatagctcagctaaacgtgagaaaggaatggttgtcaatagcaaagagatttctgatgcagtcgggcaatcaaaatttgttctagagaaccttcggcattacacagtccatccaaatttg

SEQ ID NO: 190281 - DNA, 548 bp, Homo sapiens
  Payload ID: 17584
  Gene Name: testis specific, 13
  ENST ID: ENST00000443954
  CDS Start-End: 320-548
aaattccctctgtctcctccagaatccagaaaagaataattacgatattttcaaaatggaaagttcccatgccaaagactttgccttcttcaccaaactatgatttcgtgatgttcttaaagtttcaccatatacatgaattggacttacaattccagaaaaattaaaggctcaagaatggggcatgagtacacactgtgtgctaaggaaagaatatttggattgaattgaacccctgcagaacgtggactatttagagacctgaatttggccttgggtgaatacctgccttgggttggccaactagcagtcaacagcaatgagccaaaagagacaaaccaagtttcaaaatggcaaatcaaagacttcagaaaatagctcagctaaacgtgagaaaggaatggttgtcaatagcaaagagatttctgatgcagtcgggcaatcaaaatttgttctagagaaccttcggcattacacagtccatccaaatttggcccagtactataagcctttgaaggccactgccctgcagaaattcctggctcaaa

SEQ ID NO: 190282 - DNA, 1079 bp, Homo sapiens
  Payload ID: 17585
  Gene Name: testis, prostate and placenta expressed
  Uniprot ID: Q6URK8
  ENST ID: ENST00000290871
  CDS Start-End: 38-934
ggttgctaaggagtgggtgcctcagaatcaggctgcaatgggcattgtctgtgcacaatgttcctttattctgctgctgtccataataagggctcgtccacctcccttcctcttctgcccattgagcagtcaaagaactgaaagtccttataagcctgtgcacctgggcctgggccctacagataaggtagctgctattgctatggcccgcatcattgacctggtgccctgggacgatggctccacacatgtgtatgcctccccggccatcctgcttcccatggagcggcagcgcaaccagctggcgggcgtgaagcagcagctctaccacccagccctgcccaccctgcgccacatggacagggacaccgtcaaggcctgccttcctgatgagcactgccagtccaccacctactgccgcaaagatgaatttgacaacgcccattttacactccttggggtccccaacaaacccctgcagtgtttggacatcaccgccacaggccagaagcttcgcaacaggtaccacgagggaaagctggcgcccatcgcgccaggcatcaaccgagtggactggccctgcttcacgcgcgccatcgaggactggtcccacttcgtgtcctcggccggggagttcaagctgccttgcctgaggaagcgagcggagggtctcagcggctacgcggtgcggtacttgaagcccgacgtgacccagacctggcggcaggaagccctgtgtggggcgtgggcagggcgtccgtgctcccccgactcaccgcgcccctatccctgctgcccgcctcagtactgcctcagccagaaccccagcctggaccgctacggacagaagcccctgcctttcgactccctgaacactttccgaagcttcggctccagctacagtcgtgtcaactacctgaccccctggcattaatctctggaaaggaggctgactcccaggctgccggacggtgccacctcaggtcccctggccagacagaggacttatggtggcaccagccatctccccaggagttcagcctaactagaaataaacctaatgctcccttagagacaca

SEQ ID NO: 190283 - DNA, 998 bp, Homo sapiens
  Payload ID: 17585
  Gene Name: testis, prostate and placenta expressed
  Uniprot ID: Q6URK8
  ENST ID: ENST00000441824
  CDS Start-End: 38-853
ggttgctaaggagtgggtgcctcagaatcaggctgcaatgggcattgtctgtgcacaatgttcctttattctgctgctgtccataataagggctcgtccacctcccttcctcttctgcccattgagcagtcaaagaactgaaagtccttataagcctgtgcacctgggcctgggccctacagataaggtagctgctattgctatggcccgcatcattgacctggtgccctgggacgatggctccacacatgtgtatgcctccccggccatcctgcttcccatggagcggcagcgcaaccagctggcgggcgtgaagcagcagctctaccacccagccctgcccaccctgcgccacatggacagggacaccgtcaaggcctgccttcctgatgagcactgccagtccaccacctactgccgcaaagatgaatttgacaacgcccattttacactccttggggtccccaacaaacccctgcagtgtttggacatcaccgccacaggccagaagcttcgcaacaggtaccacgagggaaagctggcgcccatcgcgccaggcatcaaccgagtggactggccctgcttcacgcgcgccatcgaggactggtcccacttcgtgtcctcggccggggagttcaagctgccttgcctgaggaagcgagcggagggtctcagcggctacgcggtgcggtacttgaagcccgacgtgacccagacctggcggtactgcctcagccagaaccccagcctggaccgctacggacagaagcccctgcctttcgactccctgaacactttccgaagcttcggctccagctacagtcgtgtcaactacctgaccccctggcattaatctctggaaaggaggctgactcccaggctgccggacggtgccacctcaggtcccctggccagacagaggacttatggtggcaccagccatctccccaggagttcagcctaactagaaataaacctaatgctcccttagagacaca

SEQ ID NO: 190284 - DNA, 2421 bp, Homo sapiens
  Payload ID: 17586
  Gene Name: testis-specific kinase 1
  Uniprot ID: Q15569
  ENST ID: ENST00000336395
  CDS Start-End: 251-2131
caccgccaccgcccggtccaggcccaagcccaggccctgcgcggagcggagcggcgcggcgtccacccgggcccagccagccggcgcggcgggggcgggtccaggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggctctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctgtcctggccggtcaggctccacctggccctggacattgcccgaggcctgcggtacctgcactccaaaggtgtatttcaccgcgacctcacatccaagaactgtctagtccgacgggaagatcgaggcttcaccgctgtcgtgggtgacttcgggctggccgaaaagattcctgtgtatagggagggggcaaggaaggagccattggccgtggtgggctccccatactggatggctccagaggtgttacggggtgagctgtatgatgagaaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagccctgagccggaacctccagggccagcgccccagctgcctctggctgtggccacagacaacttcatcagcacctgttcctcggcctcccaaccctggtcccctagatcaggacccgtcctcaataacaatcccccagctgtggtggtgaactccccacaaggctgggctggggagccctggaaccgggcccagcatagcctgccccgggcggcagccctggagcggacagaaccctcgccacccccttcagctccccgggagcccgatgaggggctgccctgtcctggctgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgcccct

SEQ ID NO: 190285 - DNA, 2438 bp, Homo sapiens
  Payload ID: 17586
  Gene Name: testis-specific kinase 1
  Uniprot ID: Q15569
  ENST ID: ENST00000620767
  CDS Start-End: 268-2148
ccgcccgcccgcctccgcccgcggcaagccagcccgccggcgccccggagcgctgccgccaccgtcaccgccaccgcccggtccaggcccaagcccaggccctgcgcggagcggagcggcggatcttcggcggatcttccattctcagggcgggagccggagtccgggcgcccgggatcgggctgggcccgcgcccatggcaagcgcggcctgcccgggccctggggaccctgccatgtgaggcaggcccgggctgggggcccggccatggccggggaacggcccccactgcggggccctgggcccgggcctggagaggtgccgggggaggggcccccggggccggggggcacgggcggaggcccgggccggggccgcccctcctcctaccgggctctccgcagcgccgtgtctagcctggcgcgtgtggacgattttcactgcgcggagaagatcggggccggcttcttctctgaggtctacaaggttcggcaccgacagtcagggcaagtcatggtgctgaagatgaacaagctccccagtaaccggggcaacacactacgggaagtgcagctgatgaaccggctcaggcaccccaacatcctaaggttcatgggagtctgtgtgcaccagggacagctgcacgctcttacagagtatatgaatggggggacattggaacagctgctcagctcccctgaacccctgtcctggccggtcaggctccacctggccctggacattgcccgaggcctgcggtacctgcactccaaaggtgtatttcaccgcgacctcacatccaagaactgtctagtccgacgggaagatcgaggcttcaccgctgtcgtgggtgacttcgggctggccgaaaagattcctgtgtatagggagggggcaaggaaggagccattggccgtggtgggctccccatactggatggctccagaggtgttacggggtgagctgtatgatgagaaggctgatgtctttgccttcgggattgtcctctgtgagctcatcgcccgagtacctgcagaccctgactacctaccacgcactgaggactttggcctggatgtgcctgctttccgaactctggtgggggatgactgcccactgcctttcttgctcctggccatccactgctgcaacctggaacccagcacccgtgcccccttcaccgaaattacccagcacctggaatggatcctggagcagctgcctgagccagccccactcaccaggaccgccctgacacacaatcagggctctgttgcaagagggggtccctctgccacgcttcccaggccagatccccggctttcccgaagccggtcagacctcttcctgcccccatcaccagaatcaccccccaactggggggacaatctgactcgagtcaaccccttctcactacgggaagacctcaggggtggcaagatcaagctcttagacacacccagcaagccagtcctgcctcttgtgccaccatcaccattcccatccactcagctgcccttggtgaccactccggagaccctggtccagcctgggacacctgcccgccgctgccgctcactaccctcatcccccgagctcccccgccgtatggagacagcactgccaggtcctggccctcccgctgtgggcccctcggctgaagagaagatggagtgcgagggcagcagccctgagccggaacctccagggccagcgccccagctgcctctggctgtggccacagacaacttcatcagcacctgttcctcggcctcccaaccctggtcccctagatcaggacccgtcctcaataacaatcccccagctgtggtggtgaactccccacaaggctgggctggggagccctggaaccgggcccagcatagcctgccccgggcggcagccctggagcggacagaaccctcgccacccccttcagctccccgggagcccgatgaggggctgccctgtcctggctgctgcctcggccccttcagctttggcttcctgtccatgtgcccccgccccacaccagctgttgcccgctaccgcaacctgaactgtgaggcgggcagtctcctctgccaccgagggcaccacgccaagccacccacacccagcctgcagctgcctggggcacgctcttagcagtggagcccgtggtctcaggcctccaactttggccttcaggacaccctgtaagaacagagcacacttgctggacagtgccagttccagatgggctgaccggctcttctccccgtgtaggggagccccagcatggactcaagggacagagcacttccagtcgaccccccggctcgcgttcccgtggggatcactgaaccagacacagcattgctgacacatgagactaacacgtgcaattatttaaaaagatttcaataaaactgcctggctggctccgggccgcccct

SEQ ID NO: 190286 - DNA, 2600 bp, Homo sapiens
  Payload ID: 17587
  Gene Name: testis-specific kinase 2
  Uniprot ID: Q96S53
  ENST ID: ENST00000372084
  CDS Start-End: 15-1643
tgattatttagactatggatcggagcaaacggaattcaattgcaggatttcctccacgtgtggagcgtcttgaagagtttgaaggaggtggtggaggagaaggaaatgtgagccaggtgggaagagtttggccatcttcgtatcgagctcttataagtgccttttccagactgacgcgtttggatgatttcacctgtgaaaaaatagggtctggcttcttttctgaagtgttcaaggtacgacaccgagcttctggtcaggtgatggctcttaagatgaacacattgagcagtaaccgggcaaacatgctgaaagaagtacagctcatgaatagactctcccatcccaacatccttaggttcatgggtgtatgtgttcatcaaggacaattgcatgcacttacagagtatatcaactccgggaacctggaacagttgctagacagtaacctgcatttgccttggactgtgagggtaaaactggcctatgacatagcagtgggcctcagctaccttcacttcaaaggcatttttcatcgggacctcacatctaagaactgcctgataaagagggatgagaatggttactctgcagtggtagctgactttggcctggctgagaagatccccgatgtcagcatggggagtgagaagctggccgtggtgggttccccattctggatggcacctgaggttctccgagatgagccctataatgaaaaggcagatgtgttctcttatggtatcatcctctgcgagatcatcgcccgcatccaggccgatccggactatcttccccgcacagagatggatcccaaactgcgcccatcttttgtggagattgggaagaccctggaggaaattctgagccgcctacaggaagaagagcaggagagggataggaagctgcagcccacagccaggggactcttggagaaagcacctggggtgaagcgactaagctcactggatgacaagatcccccacaagtcaccatgcccaagacgtaccatctggctgtctcgaagccagtcagatatcttttcccgtaagcccccacgtacagtgagtgtcttggacccatactaccggccacgagatggtgctgcccgcacccccaaagtcaacccttttagtgctcgccaggacctcatggggggcaagatcaagttttttgacctgcccagcaagtctgtcatctctctggtatttgacctggatgcaccagggcccggaactatgcccctggctgactggcaggagcccctggccccacctattcgccggtggcgttccttgcctggttcgcctgagttcttgcatcaagaggcttgtccatttgtgggccgggaagaatcgctatctgatgggcccccaccacgcctaagtagtctcaagtacagagttaaagagatcccaccattccgggcatctgccctaccagctgctcaagcccatgaggctatggactgctccattctccaggaagaaaatggttttgggtccaggccccaggggaccagtccatgccctgcgggtgcttctgaggagatggaggtagaagaaaggccagcaggctcaactccagccaccttctccacctcaggcataggcctgcaaacccagggaaagcaggatgggtgagggggtttagtccctgcctcaccttggggatggaccttcagctgaaaccatatggccccctaggtgcacagccttgattcttccctggagcctacagagcaggcaggctaggccaagccaggctcaacttctgggctcccagtgcccattggctgtgtatgacgggaggcagcagtgagaggccttcctagttagggccaacagctgataccaagcctctgaaatccagcaaggaggtctgcctcccaccagaccctctccagtgtacttccccagataggaccagaggatgtctagttctaggctgagctggcaggcagctattaccccggttctttccccaccccaggtctgtctcttgccttttcttggggcatataagctactgagtggaacatggagctgatcaagaggccgtaatggtcatggctgtttcccagacctgaatattggggtgcttcttgccagtattctaagacatttgagtaattgctgtttgcacttactgcatggtcagaccacgtcactacatttctatgcaaggggacagcaaggcagcgtggtggtcatggctcttagctaacctattcaaagaccttttcctgttgattaatctattttcatatttataaaggagtcttaatgttctgccccataagactttcaaccttgtggttgggagtggggctggttttgtaggccctagggcctgcttctatgtatttatcaacatgtgatacattcaattggttaaatggtttatacagggactgatttgcttcccttcctgccatggctggagctttgggaacagtctgtccttacagagctgcaataagaaataaccaaagatgaagctggtcaaatattttcataacttgcttctgttgatttttttttttgtaaaactttcccaagacattttcagacttaaaaataaagtcagtgttacaggtg

SEQ ID NO: 190287 - DNA, 3074 bp, Homo sapiens
  Payload ID: 17587
  Gene Name: testis-specific kinase 2
  Uniprot ID: Q96S53
  ENST ID: ENST00000372086
  CDS Start-End: 402-2117
agtctttcgcggcccgggagctcagcagagctaccagctgccctgttggcttcgctggtcggatcgtcctcctggccccgccaaacaggcggggggagcggccccgactgtggggccatggcagtagtctcctcgttcgccgccgccgctagcctagctgagtcgccggcttctgcgctaggggctcccaccgcctccgcaggctaaggagccgctgccaccaacgagctgtgagggttactatgctccctctttgccgccgtctcctcctcttgcccgcgcaggcacccctctggctgctcagtcctgcctcagtgtcaaaccagaagagaagtaaaattcaacaaaaatttatgtgtggagttccttcttaaaagaagaaaaaagtgattatttagactatggatcggagcaaacggaattcaattgcaggatttcctccacgtgtggagcgtcttgaagagtttgaaggaggtggtggaggagaaggaaatgtgagccaggtgggaagagtttggccatcttcgtatcgagctcttataagtgccttttccagactgacgcgtttggatgatttcacctgtgaaaaaatagggtctggcttcttttctgaagtgttcaaggtacgacaccgagcttctggtcaggtgatggctcttaagatgaacacattgagcagtaaccgggcaaacatgctgaaagaagtacagctcatgaatagactctcccatcccaacatccttaggttcatgggtgtatgtgttcatcaaggacaattgcatgcacttacagagtatatcaactccgggaacctggaacagttgctagacagtaacctgcatttgccttggactgtgagggtaaaactggcctatgacatagcagtgggcctcagctaccttcacttcaaaggcatttttcatcgggacctcacatctaagaactgcctgataaagagggatgagaatggttactctgcagtggtagctgactttggcctggctgagaagatccccgatgtcagcatggggagtgagaagctggccgtggtgggttccccattctggatggcacctgaggttctccgagatgagccctataatgaaaaggcagatgtgttctcttatggtatcatcctctgcgagatcatcgcccgcatccaggccgatccggactatcttccccgcacagagaatttcgggctggactatgatgctttccagcacatggtgggagactgtcccccagattttctgcaacttactttcaactgctgtaacatggatcccaaactgcgcccatcttttgtggagattgggaagaccctggaggaaattctgagccgcctacaggaagaagagcaggagagggataggaagctgcagcccacagccaggggactcttggagaaagcacctggggtgaagcgactaagctcactggatgacaagatcccccacaagtcaccatgcccaagacgtaccatctggctgtctcgaagccagtcagatatcttttcccgtaagcccccacgtacagtgagtgtcttggacccatactaccggccacgagatggtgctgcccgcacccccaaagtcaacccttttagtgctcgccaggacctcatggggggcaagatcaagttttttgacctgcccagcaagtctgtcatctctctggtatttgacctggatgcaccagggcccggaactatgcccctggctgactggcaggagcccctggccccacctattcgccggtggcgttccttgcctggttcgcctgagttcttgcatcaagaggcttgtccatttgtgggccgggaagaatcgctatctgatgggcccccaccacgcctaagtagtctcaagtacagagttaaagagatcccaccattccgggcatctgccctaccagctgctcaagcccatgaggctatggactgctccattctccaggaagaaaatggttttgggtccaggccccaggggaccagtccatgccctgcgggtgcttctgaggagatggaggtagaagaaaggccagcaggctcaactccagccaccttctccacctcaggcataggcctgcaaacccagggaaagcaggatgggtgagggggtttagtccctgcctcaccttggggatggaccttcagctgaaaccatatggccccctaggtgcacagccttgattcttccctggagcctacagagcaggcaggctaggccaagccaggctcaacttctgggctcccagtgcccattggctgtgtatgacgggaggcagcagtgagaggccttcctagttagggccaacagctgataccaagcctctgaaatccagcaaggaggtctgcctcccaccagaccctctccagtgtacttccccagataggaccagaggatgtctagttctaggctgagctggcaggcagctattaccccggttctttccccaccccaggtctgtctcttgccttttcttggggcatataagctactgagtggaacatggagctgatcaagaggccgtaatggtcatggctgtttcccagacctgaatattggggtgcttcttgccagtattctaagacatttgagtaattgctgtttgcacttactgcatggtcagaccacgtcactacatttctatgcaaggggacagcaaggcagcgtggtggtcatggctcttagctaacctattcaaagaccttttcctgttgattaatctattttcatatttataaaggagtcttaatgttctgccccataagactttcaaccttgtggttgggagtggggctggttttgtaggccctagggcctgcttctatgtatttatcaacatgtgatacattcaattggttaaatggtttatacagggactgatttgcttcccttcctgccatggctggagctttgggaacagtctgtccttacagagctgcaataagaaataaccaaagatgaagctggtcaaatattttcataacttgcttctgttgatttttttttttgtaaaactttcccaagacattttcagacttaaaaataaagtcagtgttacaggtg

SEQ ID NO: 190288 - DNA, 2478 bp, Homo sapiens
  Payload ID: 17588
  Gene Name: testis-specific serine kinase 1B
  Uniprot ID: Q9BXA7
  ENST ID: ENST00000390666
  CDS Start-End: 193-1296
ttcactcgctgaagtcatctgggagacagtgccaaatgttccactccagagtcttggcctctaggaggcaggaacagcaggcctggccagcccaaaggactctctatccaggatgtaaatgagcacactgctggcccatgcgcctcggggctgtagagggcagcctcagaggcactgggcattcctggcaccatggatgacgctgctgtcctcaagcgacgaggctacctcctggggataaatttaggagagggctcctatgcaaaagtaaaatctgcttactctgagcgcctgaagttcaatgtggcgatcaagatcatcgaccgcaagaaggcccccgcagacttcttggagaaattccttccccgggaaattgagattctggccatgttaaaccactgctccatcattaagacctacgagatctttgagacatcacatggcaaggtctacatcgtcatggagctcgcggtccagggcgacctcctcgagttaatcaaaacccggggagccctgcatgaggacgaagctcgcaagaagttccaccagctttccttggccatcaagtactgccacgacctggacgtcgtccaccgggacctcaagtgtgacaaccttctccttgacaaggacttcaacatcaagctgtccgacttcagcttctccaagcgctgcctgcgggatgacagtggtcgaatggcattaagcaagaccttctgtgggtcaccagcgtatgcggccccagaggtgctgcagggcattccctaccagcccaaggtgtacgacatctggagcctaggcgtgatcctctacatcatggtctgcggctccatgccctacgacgactccaacatcaagaagatgctgcgtatccagaaggagcaccgcgtcaacttcccacgctccaagcacctgacaggcgagtgcaaggacctcatctaccacatgctgcagcccgacgtcaaccggcggctccacatcgacgagatcctcagccactgctggatgcagcccaaggcacggggatctccctctgtggccatcaacaaggagggggagagttcccggggaactgaacccttgtggacccccgaacctggctctgacaagaagtctgccaccaagctggagcctgagggagaggcacagccccaggcacagcctgagacaaaacccgaggggacagcaatgcaaatgtccaggcagtcggagatcctgggtttccccagcaagccgtcgactatggagacagaggaagggcccccccaacagcctccagagacgcgggcccagtgagcttcttgcggcccagggaatgagatggagctcacggcttaaagcccaagctctgaagaagtcaagggtggagccagagaaggaaggcagtcccagatgagcctctattttcatcagcttcttctctctccccttgaacttggtaacccacatggttctcccgtggcccctaggtggatgaggccaaagtcaaatccaaggctgagacagtcgtgcgactcctactcccccagagcgtgacccggagcaggtgctggacacagagcctgtctcagcagagggtccccactggccgcaacggctcagtgacagcaagagcaggaagagcagcaggaaggcaccgctgtccaccttgggcaccatttatcctcctttcatcgtccccggggcagttgcgtgaccctgctgggaggccagaccgggccagactgagggtcaggggaccaggctgggttgggggttgggtggggctggacggggacgaggcgcggagaggcggcgggaaagagcttcggctgggccacgggctcgcgggcactctcggcggcagcctcgggggctccgactccagctctgggcaagatccataaacttttaaagaagcctcaaaacatacttttaaagcattaagctttaaagtgctagaaatcttgtgccccatatgtgcttctttcagtattatcctagatcctcaggagtagcatggcaactggagaaaatgggaggaaagacaagaagaaatagaagctgatttaacatcaagtttattcagttttgatttttcttatctctactggctttctcctgttcaaaccttgcagcgataatatttggaaaagagcacttggaaattatattcctgtttttaactctttatatttaatcattctccttgtaattgattttgtagctaatttactccccagcacccccagaagaaaattttacaaaggaaaatgttttatttttattttttccttatcaactttttatttaaatgctaatatccaattaatggacaaacgaatcagctaatactggaaacaatgtaacaatagtgaaaagcatgaacttttgatttctatagaccgaatttgactctgctactaaatgatcttgggcaagttggttaatctatatgtctcagtttctttatctataaaatgagaataatacaacttc

SEQ ID NO: 190289 - DNA, 1816 bp, Homo sapiens
  Payload ID: 17589
  Gene Name: testis-specific serine kinase 2
  Uniprot ID: Q96PF2
  ENST ID: ENST00000399635
  CDS Start-End: 593-1669
tcaatggtaaggcagtgctgtggaaatctgtctgtgtaactggggtgctatgcaggcctgtctgggtgactgtcagggacaactgtcctaccacaccaaggacacagccctgggggtgcttttcttcatagccaaagaagctgcaggaaacccaccctagtgggacaaagaccaatgcagggtcagtccccacagccaggtgatgcaaacaggctggacgtgggccgcctcccctccagcttgacttgtgacagggaaaccaatgcagcagcagcagggccaccagagtcctgtcctggggacaggcttccttccagcgggcggggagtgggtgctcctgccagaccagcctggcttccacggttccagagaccctgttctccctcagcccagtccccgcccccactccttggctttatgagttcattggctgaagtcacccggagacaatgctgagtgttccacccctgagtcgaagcccagcccagggcagcccagccagacgcctccggtagtgtaaatgaggacaatgcctgctggcccacatgacggggggatgtagacggcagcggcgccagtcgctcctggcaccatggacgatgccacagtcctaaggaagaagggttacatcgtaggcatcaatcttggcaagggttcctacgcaaaagtcaaatctgcctactctgagcgcctcaagttcaatgtggctgtcaagatcatcgaccgcaagaaaacacctactgactttgtggagagattccttcctcgggagatggacatcctggcaactgtcaaccacggctccatcatcaagacttacgagatctttgagacctctgacggacggatctacatcatcatggagcttggcgtccagggcgacctcctcgagttcatcaagtgccagggagccctgcatgaggacgtggcacgcaagatgttccgacagctctcctccgccgtcaagtactgccacgacctggacatcgtccaccgggacctcaagtgcgagaaccttctcctcgacaaggacttcaacatcaagctgtctgactttggcttctccaagcgctgcctgcgggacagcaatgggcgcatcatcctcagcaagaccttctgcgggtcggcagcatatgcagcccccgaggtgctgcagagcatcccctaccagcccaaggtgtatgacatctggagcctgggcgtgatcctgtacatcatggtctgcggctccatgccctatgacgactccgacatcaggaagatgctgcgtatccagaaggagcaccgtgtggacttcccgcgctccaagaacctgacctgcgagtgcaaggacctcatctaccgcatgctgcagcccgacgtcagccagcggctccacatcgatgagatcctcagccactcgtggctgcagccccccaagcccaaagccacgtcttctgcctccttcaagagggagggggagggcaagtaccgcgctgagtgcaaactggacaccaagacaggcttgaggcccgaccaccggcccgaccacaagcttggagccaaaacccagcaccggctgctggtggtgcccgagaacgagaacaggatggaggacaggctggccgagacctccagggccaaagaccatcacatctccggagctgaggtggggaaagcaagcacctagcatgacaatggccccgttgtgtgtggtgggggtcggggttggggggcatggtgcagtcggccttcacgtaaactaagtaggcaggtaggatctgaagaaggcacaggtgcaagtaaaattcgtcaattaaaccactattttgattac

SEQ ID NO: 190290 - DNA, 1368 bp, Homo sapiens
  Payload ID: 17590
  Gene Name: testis-specific serine kinase 3
  Uniprot ID: Q96PN8
  ENST ID: ENST00000373534
  CDS Start-End: 506-1312
cggggactggaggcctctggccatggcgcctggagacggggtcgcgcagaccccggacacccgaggggggcgcagcaggccagggcaacccgccgcgaggcggcgtccacgccgaggagccgcgcattcccggtccacacagacgcggcggagcgccctcccaggcgggactacaactcaatgcctggcacgggggcgggctcggcggtgacttaatccgggctgagtttggtggtggtagtgagggcaggtaggggcactgcccattttggccaagggtcacacagcatctacatcacaattgcaccggagtttaaaaatgtctggccctgtccctccccaccacccgccgctgtgtccagacagagaatgttctaacgctgggggcggctgcggatgaagtccttggggagaaaaggagcaggccaagggcgatggtggagtagagctgcctctcagaggcagcatgagctgagagggtgataggaaggcggcgctagacagcatggaggactttctgctctccaatgggtaccagctgggcaagaccattggggaagggacctactcaaaagtcaaagaagcattttccaaaaaacaccaaagaaaagtggcaattaaagttatagacaagatgggagggccagaagagtttatccagagattcctccctcgggagctccaaatcgtccgtaccctggaccacaagaacatcatccaggtgtatgagatgctggagtctgccgacgggaaaatctgcctggtgatggagctcgctgagggaggggatgtctttgactgcgtgctgaatggggggccactgcctgaaagccgggccaaggccctcttccgtcagatggttgaggccatccgctactgccatggctgtggtgtggcccaccgggacctcaaatgtgagaacgccttgttgcagggcttcaacctgaagctgactgactttggctttgccaaggtgttgcccaagtcacaccgggagctgagccagaccttctgcggcagtacagcctatgctgcccccgaggtgctgcagggcattccccacgatagcaaaaaaggtgatgtctggagcatgggtgtggtcctgtatgtcatgctctgtgccagcctaccttttgacgacacagacatccccaagatgctgtggcagcagcagaagggggtgtccttccccactcatctgagcatctcggccgattgccaggacctgctcaagaggctcctggaacccgatatgatcctccggccttcaattgaagaagttagttggcatccatggctagcaagcacttgataaaagcaatggcaagtgctctccaataaagtagggggagaaagcaaacccaaaaa

SEQ ID NO: 190291 - DNA, 273 bp, Homo sapiens
  Payload ID: 17590
  Gene Name: testis-specific serine kinase 3
  ENST ID: ENST00000574315
  CDS Start-End: 169-273
agaagaggaaactgaggttcacaatcgggcagtgaaaagccaaaagtaaaacctaggctttctacaactctgcctgctcctacaaaagagtttatccagagattcctccctcgggagctccaaatcgtccgtaccctggaccacaagaacatcatccaggtgtatgagatgctggagtctgccgacgggaaaatctgcctggtgatggagctcgctgagggaggggatgtctttgactgcgtgctgaatggggggccactgcctgaaagccgg

SEQ ID NO: 190292 - DNA, 1257 bp, Homo sapiens
  Payload ID: 17591
  Gene Name: testis-specific serine kinase 4
  Uniprot ID: Q6SA08
  ENST ID: ENST00000287913
  CDS Start-End: 169-1155
tcctagtggagggctgagtccagcatcccagactcgtgtgactatataggcaagcatttggggacctacttcactttgataccctagccttcagcagctcaaggtgttggcctttggataggaggcttccaagtagtaaagctccctgctctcagcaagcccaacaccatggggaagggagatgtcttagaggcagcaccaaccaccacagcctaccattccctcatggatgaatatggttatgaggtgggcaaggccattggccatggctcctatgggtcggtatatgaggctttctacacaaagcagaaggttatggtggcagtcaagatcatctcaaagaagaaggcctctgatgactatcttaacaagttcctgccccgtgaaatacaggtaatgaaagtcttgcggcacaagtacctcatcaacttctatcgggccattgagagcacatctcgagtatacatcattctggaactggctcagggtggtgatgtccttgaatggatccagcgctacggggcctgctctgagccccttgctggcaagtggttctcccagctgaccctgggcattgcctacctgcacagcaagagcatcgtgcaccgggacttaaagttggagaacctgttgctggacaagtgggagaatgtgaagatatcagactttggctttgccaagatggtgccttctaaccagcctgtgggttgtagcccttcttaccgccaagtgaactgcttttcccacctcagccagacttactgtggcagctttgcttacgcttgcccagagatcttacgaggcttgccctacaaccctttcctgtctgacacctggagcatgggcgtcatcctttacactctagtggtcgcccatctgccctttgatgacaccaatctcaaaaagctgctaagagagactcagaaggaggtcactttcccagctaaccataccatctcccaggagtgcaagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaatcttttttaccaaaaataaatctaagtctgatttagtttcatcaa

SEQ ID NO: 190293 - DNA, 1321 bp, Homo sapiens
  Payload ID: 17591
  Gene Name: testis-specific serine kinase 4
  Uniprot ID: Q6SA08
  ENST ID: ENST00000339917
  CDS Start-End: 205-1221
aaaaagaactgcttctctttctttccccctccaagttcctagtggagggctgagtccagcatcccagactcgtgtgactatataggcaagcatttggggacctacttcactttgataccctagccttcagcagctcaaggtgttggcctttggataggaggcttccaagtagtaaagctccctgctctcagcaagcccaacaccatggggaagggagatgtcttagaggcagcaccaaccaccacagcctaccattccctcatggatgaatatggttatgaggtgggcaaggccattggccatggctcctatgggtcggtatatgaggctttctacacaaagcagaaggttatggtggcagtcaagatcatctcaaagaagaaggcctctgatgactatcttaacaagttcctgccccgtgaaatacaggtaatgaaagtcttgcggcacaagtacctcatcaacttctatcgggccattgagagcacatctcgagtatacatcattctggaactggctcagggtggtgatgtccttgaatggatccagcgctacggggcctgctctgagccccttgctggcaagtggttctcccagctgaccctgggcattgcctacctgcacagcaagagcatcgtgcaccgcctgatgcccagcctttctgctgctggtagggacttaaagttggagaacctgttgctggacaagtgggagaatgtgaagatatcagactttggctttgccaagatggtgccttctaaccagcctgtgggttgtagcccttcttaccgccaagtgaactgcttttcccacctcagccagacttactgtggcagctttgcttacgcttgcccagagatcttacgaggcttgccctacaaccctttcctgtctgacacctggagcatgggcgtcatcctttacactctagtggtcgcccatctgccctttgatgacaccaatctcaaaaagctgctaagagagactcagaaggaggtcactttcccagctaaccataccatctcccaggagtgcaagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaatcttttttaccaaaaataaatctaagtctgatttagtttcatc

SEQ ID NO: 190294 - DNA, 576 bp, Homo sapiens
  Payload ID: 17591
  Gene Name: testis-specific serine kinase 4
  ENST ID: ENST00000428351
  CDS Start-End: 67-474
ggtgttggcctttggataggaggcttccaagtagtaaagctccctgctctcagcaagcccaacaccatggggaagggagatgtcttagaggcagcaccaaccaccacagcctaccattccctcatggatgaatatggttatgaggtgggcaaggccattggccatggctcctatgggtcggtatatgaggctttctacacaaagcagaaggttatggtggcagtcaagatcatctcaaagaagaaggcctctgatgactatcttaacaagttcctgccccgtgaaatacagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaatcttttttaccaaaaataaatctaagtctgatttagtttcatcaa

SEQ ID NO: 190295 - DNA, 725 bp, Homo sapiens
  Payload ID: 17591
  Gene Name: testis-specific serine kinase 4
  ENST ID: ENST00000553766
  CDS Start-End: 1-326
cttaccgccaagtgaactgcttttcccacctcagccagacttactgtggcagctttgcttacgcttgcccagagatcttacgaggcttgccctacaaccctttcctgtctgacacctggagcatgggcgtcatcctttacactctagtggtcgcccatctgccctttgatgacaccaatctcaaaaagctgctaagagagactcagaaggaggtcactttcccagctaaccataccatctcccaggagtgcaaggtccaactgctcattgcctgtgtggcacaatggagaaaaactcaggcaagacctctctctcccctgctctagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaatcttttttaccaaaaataaatctaagtctgatttagtttcatcaactagggtcaaagacattcttttctcaaggcaatcttatagcagggaacactgctggagtaagagatagatttctgcccagagcctgtaaccaataatcttgacactgtgttaaa

SEQ ID NO: 190296 - DNA, 708 bp, Homo sapiens
  Payload ID: 17591
  Gene Name: testis-specific serine kinase 4
  ENST ID: ENST00000555092
  CDS Start-End: 1-430
cttagaggcagcaccaaccaccacagcctaccattccctcatggatgaatatggttatgaggtgggcaaggccattggccatggctcctatgggtcggtatatgaggctttctacacaaagcagaaggttatggtggcagtcaagatcatctcaaagaagaaggcctctgatgactatcttaacaagttcctgccccgtgaaatacaggtaatgaaagtcttgcggcacaagtacctcatcaacttctatcgggccattgagagcacatctcgagtatacatcattctggaactggctcagggtggtgatgtccttgaatggatccagcgctacggggcctgctctgagccccttgctggcaagtggttctcccagctgaccctgggcattgcctacctgcacagcaagagcatcgtgcaccgaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaatcttttttaccaaaaataaatctaagtctgatttagtttcatcaa

SEQ ID NO: 190297 - DNA, 896 bp, Homo sapiens
  Payload ID: 17591
  Gene Name: testis-specific serine kinase 4
  Uniprot ID: Q6SA08
  ENST ID: ENST00000556621
  CDS Start-End: 81-839
ctgcttctctttctttccccctccaagttcctagtggagggctgagtccagcatcccagactcgtgtgactatataggtaatgaaagtcttgcggcacaagtacctcatcaacttctatcgggccattgagagcacatctcgagtatacatcattctggaactggctcagggtggtgatgtccttgaatggatccagcgctacggggcctgctctgagccccttgctggcaagtggttctcccagctgaccctgggcattgcctacctgcacagcaagagcatcgtgcaccgggacttaaagttggagaacctgttgctggacaagtgggagaatgtgaagatatcagactttggctttgccaagatggtgccttctaaccagcctgtgggttgtagcccttcttaccgccaagtgaactgcttttcccacctcagccagacttactgtggcagctttgcttacgcttgcccagagatcttacgaggcttgccctacaaccctttcctgtctgacacctggagcatgggcgtcatcctttacactctagtggtcgcccatctgccctttgatgacaccaatctcaaaaagctgctaagagagactcagaaggaggtcactttcccagctaaccataccatctcccaggagtgcaagaacctgatcctccagatgctacgccaagccactaagcgtgccaccattctggacatcatcaaggattcctgggtgctcaagttccagcctgagcaacccacccatgagatcaggctgcttgaggccatgtgccagctccacaacaccactaaacagcaccaatccttgcaaattacgacctgaaaatggctgagggagggggctaagagaggagcaaagcaggaggtcttgggctaaaaa

SEQ ID NO: 190298 - DNA, 1519 bp, Homo sapiens
  Payload ID: 17592
  Gene Name: testis-specific serine kinase 6
  Uniprot ID: Q9BXA6
  ENST ID: ENST00000587522
  CDS Start-End: 122-943
agtgggcacatgggggtgcgggggtgtaggtgccaagcgccatggcttagacccgagattggagtccggccgccccccgacagcagccgcctcctgccccccgtgcgccctaggcgccaccatgtcgggagacaaacttctgagcgaactcggttataagctgggccgcacaattggagagggcagctactccaaggtgaaggtggccacatccaagaagtacaagggtaccgtggccatcaaggtggtggaccggcggcgagcgcccccggacttcgtcaacaagttcctgccgcgagagctgtccatcctgcggggcgtgcgacacccgcacatcgtgcacgtcttcgagttcatcgaggtgtgcaacgggaaactgtacatcgtgatggaagcggccgccaccgacctgctgcaagccgtgcagcgcaacgggcgcatccccggagttcaggcgcgcgacctctttgcgcagatcgccggcgccgtgcgctacctgcacgatcatcacctggtgcaccgcgacctcaagtgcgaaaacgtgctgctgagcccggacgagcgccgcgtcaagctcaccgacttcggcttcggccgccaggcccatggctacccagacctgagcaccacctactgcggctcagccgcctacgcgtcacccgaggtgctcctgggcatcccctacgaccccaagaagtacgatgtgtggagcatgggcgtcgtgctctacgtcatggtcaccgggtgcatgcccttcgacgactcggacatcgccggcctgccccggcgccagaaacgcggcgtgctctatcccgaaggcctcgagctgtccgagcgctgcaaggccctgatcgccgagctgctgcagttcagcccgtccgccaggccctccgcgggccaggtagcgcgcaactgctggctgcgcgccggggactccggctagaagccgggtggttccagccattcctgcagccaagggcactgggccagggcggcgcacgcgcaagaggcgcgcttcgagggaatatgcgaagctgccgcgtgctgctgcacatgcgctttttcccttccgcttccctccctttcttcccacgggggagtccgcagttgcccttgttcggaatccacgttccccgcgatcccgggagctggaggcgcatgcgcatccgcgattccctgcgaccaggccccgagagggcgagaccagaggggacggaagcattgcgcctgcgcggaactctcagcctctgcgcggagggcgtcccttcccaaccagccgtgggtgccaggttcccggttggaacctgcaataaactcgctgttcctcgcacctggctctaacggtggcccccatttgcggactagtggagaagcgatcgctccatccggggaagtcatgcatttcttgagcacctactgtctgccaggccccagagctcatggcgaagagacttgggcccatccctgccgaaaacgagacaattgaaaagtcaagtaaaataaaagaatgacatggaaa

SEQ ID NO: 190299 - DNA, 1467 bp, Homo sapiens
  Payload ID: 17592
  Gene Name: testis-specific serine kinase 6
  Uniprot ID: Q9BXA6
  ENST ID: ENST00000585580
  CDS Start-End: 259-1080
acaaagcagggaggctagggtggccccggggcggggtcccggacccccaccctaaggcggagtgacgcccgcagtcacttcacaaggcaaaaattgttacggggcaataaaaggcacaacagcggccaatgtctggcagtgggcacatgggggtgcgggggtgtaggtgccaagcgccatggcttagacccgagattggagtccggccgccccccgacagcagccgcctcctgccccccgtgcgccctaggcgccaccatgtcgggagacaaacttctgagcgaactcggttataagctgggccgcacaattggagagggcagctactccaaggtgaaggtggccacatccaagaagtacaagggtaccgtggccatcaaggtggtggaccggcggcgagcgcccccggacttcgtcaacaagttcctgccgcgagagctgtccatcctgcggggcgtgcgacacccgcacatcgtgcacgtcttcgagttcatcgaggtgtgcaacgggaaactgtacatcgtgatggaagcggccgccaccgacctgctgcaagccgtgcagcgcaacgggcgcatccccggagttcaggcgcgcgacctctttgcgcagatcgccggcgccgtgcgctacctgcacgatcatcacctggtgcaccgcgacctcaagtgcgaaaacgtgctgctgagcccggacgagcgccgcgtcaagctcaccgacttcggcttcggccgccaggcccatggctacccagacctgagcaccacctactgcggctcagccgcctacgcgtcacccgaggtgctcctgggcatcccctacgaccccaagaagtacgatgtgtggagcatgggcgtcgtgctctacgtcatggtcaccgggtgcatgcccttcgacgactcggacatcgccggcctgccccggcgccagaaacgcggcgtgctctatcccgaaggcctcgagctgtccgagcgctgcaaggccctgatcgccgagctgctgcagttcagcccgtccgccaggccctccgcgggccaggtagcgcgcaactgctggctgcgcgccggggactccggctagaagccgggtggttccagccattcctgcagccaagggcactgggccagggcggcgcacgcgcaagaggcgcgcttcgagggaatatgcgaagctgccgcgtgctgctgcacatgcgctttttcccttccgcttccctccctttcttcccacgggggagtccgcagttgcccttgttcggaatccacgttccccgcgatcccgggagctggaggcgcatgcgcatccgcgattccctgcgaccaggccccgagagggcgagaccagaggggacggaagcattgcgcctgcgcggaactctcagcctctgcgcggagggcgtcccttcccaaccagccgtgggtgccaggttcccggttggaacctgcaataaactcgctgttcctcgca

SEQ ID NO: 190300 - DNA, 878 bp, Homo sapiens
  Payload ID: 17592
  Gene Name: testis-specific serine kinase 6
  ENST ID: ENST00000602623
  CDS Start-End: 1-330
ccagacctgagcaccacctactgcggctcagccgcctacgcgtcacccgaggtgctcctgggcatcccctacgaccccaagaagtacgatgtgtggagcatgggcgtcgtgctctacgtcatggtcaccgggtgcatgcccttcgacgactcggacatcgccggcctgccccggcgccagaaacgcggcgtgctctatcccgaaggcctcgagctgtccgagcgctgcaaggccctgatcgccgagctgctgcagttcagcccgtccgccaggccctccgcgggccaggtagcgcgcaactgctggctgcgcgccggggactccggctagaagccgggtggttccagccattcctgcagccaagggcactgggccagggcggcgcacgcgcaagaggcgcgcttcgagggaatatgcgaagctgccgcgtgctgctgcacatgcgctttttcccttccgcttccctccctttcttcccacgggggagtccgcagttgcccttgttcggaatccacgttccccgcgatcccgggagctggaggcgcatgcgcatccgcgattccctgcgaccaggccccgagagggcgagaccagaggggacggaagcattgcgcctgcgcggaactctcagcctctgcgcggagggcgtcccttcccaaccagccgtgggtgccaggttcccggttggaacctgcaataaactcgctgttcctcgcacctggctctaacggtggcccccatttgcggactagtggagaagcgatcgctccatccggggaaggcaggcgcggtcatgcatttcttgagcacctactgtctgccaggccccagagctcatggcgaagagacttgggcccatccctgccgaaaacgagaca

SEQ ID NO: 190301 - DNA, 1883 bp, Homo sapiens
  Payload ID: 17593
  Gene Name: testis-specific serine kinase substrate
  Uniprot ID: Q9UJT2
  ENST ID: ENST00000246801
  CDS Start-End: 84-1862
agtggatcctgagggtctgtggtcacagtaggtaggaagtctcagaggaaggagcccctccctgggagccagacccccacaccatggcgagcgtggtggtgaagacgatctggcagtccaaagagatccatgaggccggggacacccccacgggggtggagagctgctcccagctagtcccagaggctccccggagggtgaccagccgggccaaggggatcccgaagaaaaagaaggccgtgtcgttccacggggtggagccccagatgtcccatcagcccatgcactggtgcctgaacctcaaacggtcctcggcctgcaccaacgtgtcactgctcaacctggccgccatggagcccactgactccacggggacagactccacagtggaagacctcagcggccaactcacactggctgggccccctgcctcccctaccctaccctgggatccggatgacgcagacatcacggaaatcctgagtggggtcaacagtggattggtccgcgccaaagactccatcaccagcttgaaggaaaagaccaaccgggttaaccagcacgtgcagtctctgcagagcgagtgttctgtgctgagcgagaatctggagagaaggcggcaagaggcagaagagttggaggggtactgcattcaactcaaggagaactgctggaaggtgacccggtctgtggaagatgctgaaatcaaaaccaacgtcttgaagcagaattctgccctgctggaggagaagctgcgctacctccagcagcagctgcaggatgagacgccgcgacggcaggaggccgagctgcaggagccggaggagaagcaggagccggaggagaagcaggagccggaggagaagcagaagccggaggctggcctctcctggaacagcctgggccccgccgccacgtcccagggctgccccggcccgccagggagtcccgacaaaccctcgcggccacacggcctggtccccgcaggctggggaatggggcctcgggctggcgagggcccctacgtgagcgagcaggaattgcagaagctgttcaccggcatcgaagagctgaggagagaggtgtcctcactgaccgcccggtggcatcaggaggagggggcggtgcaggaagccctgcggctgctcgggggcctgggcggcagggtcgacggcttcctaggccagtgggagcgggcacagcgcgaacaggcacagacggcgcgggacttgcaggagctgcgaggtcgggcggatgagctgtgcaccatggtggagcggtcagcagtgtctgtggcttcactgaggagcgaactggaggggctgggcccactgaaacccattctggaggagttcgggcggcaatttcagaactctcgaagagggcctgacctctccatgaacctggatcggtcccaccaaggcaactgtgcccgctgtgccagccaggggtcgcagttgtctacggagtccctgcagcagctgctggaccgagcactgacctcactagtggacgaggtgaagcagaggggcctgactcctgcctgtcccagctgtcagaggctacacaagaagattctggagctggagcgccaggccttagccaaacacgtcagggcagaggccctgagctccacccttcggctggcccaagacgaggccctgcgggccaagaacctactgctgacagacaagatgaagccagaggagaagatggccactctggaccatctacacttgaagatgtgctccctccacgatcatctcagcaacctgccacttgaggggtccacgggaacaatggggggaggcagcagtgcaggaacccccccaaaacaggggggctcagcccctgaacaataaatggcctctcatgctagcatg

SEQ ID NO: 190302 - DNA, 1367 bp, Homo sapiens
  Payload ID: 17593
  Gene Name: testis-specific serine kinase substrate
  ENST ID: ENST00000358830
  CDS Start-End: 170-1348
gggggcagtcccaggatttgtgggaggaggtcagatgcacgagggactcaagatacacttttaggtggaactccctgccccgacaccaccaccacactgcaccttcgtgcacatagtcatccttagaactcgctgataagagggattcaaatgaggctccaacacccagatgggggactcttgccctgcagtcacattcaggtcccagaaagagaatcgagctggacttcaggagaagctgcgctacctccagcagcagctgcaggatgagacgccgcgacggcaggaggccgagctgcaggagccggaggagaagcaggagccggaggagaagcaggagccggaggagaagcagaagccggaggctggcctctcctggaacagcctgggccccgccgccacgtcccagggctgccccggcccgccagggagtcccgacaaaccctcgcggccacacggcctggtccccgcaggctggggaatggggcctcgggctggcgagggcccctacgtgagcgagcaggaattgcagaagctgttcaccggcatcgaagagctgaggagagaggtgtcctcactgaccgcccggtggcatcaggaggagggggcggtgcaggaagccctgcggctgctcgggggcctgggcggcagggtcgacggcttcctaggccagtgggagcgggcacagcgcgaacaggcacagacggcgcgggacttgcaggagctgcgaggtcgggcggatgagctgtgcaccatggtggagcggtcagcagtgtctgtggcttcactgaggagcgaactggaggggctgggcccactgaaacccattctggaggagttcgggcggcaatttcagaactctcgaagagggcctgacctctccatgaacctggatcggtcccaccaaggcaactgtgcccgctgtgccagccaggggtcgcagttgtctacggagtccctgcagcagctgctggaccgagcactgacctcactagtggacgaggtgaagcagaggggcctgactcctgcctgtcccagctgtcagaggctacacaagaagattctggagctggagcgccaggccttagccaaacacgtcagggcagaggccctgagctccacccttcggctggcccaagacgaggccctgcgggccaagaacctactgctgacagacaagatgaagccagaggagaagatggccactctggaccatctacacttgaagatgtgctccctccacgatcatctcagcaacctgccacttgaggggtccacgggaacaatggggggaggcagcagtgcaggaacccccccaaaacaggggggctcagcccctgaacaataaatggcctctcatgctagca

SEQ ID NO: 190303 - DNA, 9288 bp, Homo sapiens
  Payload ID: 17594
  Gene Name: tet methylcytosine dioxygenase 1
  Uniprot ID: Q8NFU7
  ENST ID: ENST00000373644
  CDS Start-End: 210-6620
ggcgcgagttggaaagtttgcccgagggctggtgcaggcttggagctgggggccgtgcgctgccctgggaatgtgacccggccagcgaccaaaaccttgtgtgactgagctgaagagcagtgcatccagattctcctcagaagtgagactttccaaaggaccaatgactctgtttcctgcgccctttcattttttcctactctgtagctatgtctcgatcccgccatgcaaggccttccagattagtcaggaaggaagatgtaaacaaaaaaaagaaaaacagccaactacgaaagacaaccaagggagccaacaaaaatgtggcatcagtcaagactttaagccctggaaaattaaagcaattaattcaagaaagagatgttaagaaaaaaacagaacctaaaccacccgtgccagtcagaagccttctgacaagagctggagcagcacgcatgaatttggataggactgaggttctttttcagaacccagagtccttaacctgcaatgggtttacaatggcgctacgaagcacctctcttagcaggcgactctcccaacccccactggtcgtagccaaatccaaaaaggttccactttctaagggtttagaaaagcaacatgattgtgattataagatactccctgctttgggagtaaagcactcagaaaatgattcggttccaatgcaagacacccaagtccttcctgatatagagactctaattggtgtacaaaatccctctttacttaaaggtaagagccaagagacaactcagttttggtcccaaagagttgaggattccaagatcaatatccctacccacagtggccctgcagctgagatccttcctgggccactggaagggacacgctgtggtgaaggactattctctgaagagacattgaatgataccagtggttccccaaaaatgtttgctcaggacacagtgtgtgctccttttccccaaagagcaacccccaaagttacctctcaaggaaaccccagcattcagttagaagagttgggttcacgagtagaatctcttaagttatctgattcttacctggatcccattaaaagtgaacatgattgctaccccacctccagtcttaataaggttatacctgacttgaaccttagaaactgcttggctcttggtgggtctacgtctcctacctctgtaataaaattcctcttggcaggctcaaaacaagcgacccttggtgctaaaccagatcatcaagaggccttcgaagctactgcaaatcaacaggaagtttctgataccacctctttcctaggacaggcctttggtgctatcccacatcaatgggaacttcctggtgctgacccagttcatggtgaggccctgggtgagaccccagatctaccagagattcctggtgctattccagtccaaggagaggtctttggtactattttagaccaacaagaaactcttggtatgagtgggagtgttgtcccagacttgcctgtcttccttcctgttcctccaaatccaattgctacctttaatgctccttccaaatggcctgagccccaaagcactgtctcatatggacttgcagtccagggtgctatacagattttgcctttgggctcaggacacactcctcaatcatcatcaaactcagagaaaaattcattacctccagtaatggctataagcaatgtagaaaatgagaagcaggttcatataagcttcctgccagctaacactcaggggttcccattagcccctgagagaggactcttccatgcttcactgggtatagcccaactctctcaggctggtcctagcaaatcagacagagggagctcccaggtcagtgtaaccagcacagttcatgttgtcaacaccacagtggtgactatgccagtgccaatggtcagtacctcctcttcttcctataccactttgctaccgactttggaaaagaagaaaagaaagcgatgtggggtctgtgaaccctgccagcagaagaccaactgtggtgaatgcacttactgcaagaacagaaagaacagccatcagatctgtaagaaaagaaaatgtgaggagctgaaaaagaaaccatctgttgttgtgcctctggaggttataaaggaaaacaagaggccccagagggaaaagaagcccaaagttttaaaggcagattttgacaacaaaccagtaaatggccccaagtcagaatccatggactacagtagatgtggtcatggggaagaacaaaaattggaattgaacccacatactgttgaaaatgtaactaaaaatgaagacagcatgacaggcatcgaggtggagaagtggacacaaaacaagaaatcacagttaactgatcacgtgaaaggagattttagtgctaatgtcccagaagctgaaaaatcgaaaaactctgaagttgacaagaaacgaaccaaatctccaaaattgtttgtacaaaccgtaagaaatggcattaaacatgtacactgtttaccagctgaaacaaatgtttcatttaaaaaattcaatattgaagaattcggcaagacattggaaaacaattcttataaattcctaaaagacactgcaaaccataaaaacgctatgagctctgttgctactgatatgagttgtgatcatctcaaggggagaagtaacgttttagtattccagcagcctggctttaactgcagttccattccacattcttcacactccatcataaatcatcatgctagtatacacaatgaaggtgatcaaccaaaaactcctgagaatataccaagtaaagaaccaaaagatggatctcccgttcaaccaagtctcttatcgttaatgaaagataggagattaacattggagcaagtggtagccatagaggccctgactcaactctcagaagccccatcagagaattcctccccatcaaagtcagagaaggatgaggaatcagagcagagaacagccagtttgcttaatagctgcaaagctatcctctacactgtaagaaaagacctccaagacccaaacttacagggagagccaccaaaacttaatcactgtccatctttggaaaaacaaagttcatgcaacacggtggttttcaatgggcaaactactaccctttccaactcacatatcaactcagctactaaccaagcatccacaaagtcacatgaatattcaaaagtcacaaattcattatctctttttataccaaaatcaaattcatccaagattgacaccaataaaagtattgctcaagggataattactcttgacaattgttccaatgatttgcatcagttgccaccaagaaataatgaagtggagtattgcaaccagttactggacagcagcaaaaaattggactcagatgatctatcatgtcaggatgcaacccatacccaaattgaggaagatgttgcaacacagttgacacaacttgcttcgataattaagatcaattatataaaaccagaggacaaaaaagttgaaagtacaccaacaagccttgtcacatgtaatgtacagcaaaaatacaatcaggagaagggcacaatacaacagaaaccaccttcaagtgtacacaataatcatggttcatcattaacaaaacaaaagaacccaacccagaaaaagacaaaatccaccccatcaagagatcggcggaaaaagaagcccacagttgtaagttatcaagaaaatgatcggcagaagtgggaaaagttgtcctatatgtatggcacaatatgcgacatttggatagcatcgaaatttcaaaattttgggcaattttgtccacatgattttcctactgtatttgggaaaatttcttcctcgaccaaaatatggaaaccactggctcaaacgaggtccattatgcaacccaaaacagtatttccaccactcactcagataaaattacagagatatcctgaatcagcagaggaaaaggtgaaggttgaaccattggattcactcagcttatttcatcttaaaacggaatccaacgggaaggcattcactgataaagcttataattctcaggtacagttaacggtgaatgccaatcagaaagcccatcctttgacccagccctcctctccacctaaccagtgtgctaacgtgatggcaggcgatgaccaaatacggtttcagcaggttgttaaggagcaactcatgcatcagagactgccaacattgcctggtatctctcatgaaacacccttaccggagtcagcactaactctcaggaatgtaaatgtagtgtgttcaggtggaattacagtggtttctaccaaaagtgaagaggaagtctgttcatccagttttggaacatcagaattttccacagtggacagtgcacagaaaaattttaatgattatgccatgaacttctttactaaccctacaaaaaacctagtgtctataactaaagattctgaactgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgtcccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgcagctgctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctgaaggcttttctccccctcttaatgcctttgctagtgcagtgtattttttcaaggtgctgttaaaagaaagtcatgttgtcgtttactatcttcatctcacccatttcaagtctgaggtaaaaaaataataatgataacaaaacggggtgggtattcttaactgtgactatattttgacaattggtagaaggtgcacattttaagcaaaaataaaagttttatagttttaaatacataaagaaatgtttcagttaggcattaaccttgatagaatcactcagtttggtgctttaaattaagtctgtttactatgaaacaagagtcatttttagaggattttaacaggttcatgttctatgatgtaaaatcaagacacacagtgttaactctacacagcttctggtgcttaaccacatccacacagttaaaaataagctgaattattatttcatggtgccattgttccaacatcttccaatcattgctagaaaattggcatattcctttgaaataaacttatgaaatgttttctctcttaaaatatttctcctgtgtaaaataaatcattgttgttagtaatggttggaggctgttcataaattgtaaatatatattttaaaagcactttctatttttaaaagtaacttgaaataatatagtataagaatcctattgtctattgtttgtgcatatttgcatacaagagaaatcatttatccttgctgtgtagagttccatcttgttaactgcagtatgtattctaatcatgtatatggtttgtgttcttttactgtgtcctctcacattcaagtattagcaacttgcagtatataaaatagttagataatgagaagttgttaattatctctaaaattggaattaggaagcatatcaccaatactgattaacattctctttggaactaggtaagagtggtctcttcttattgaacaacctcaatttagtttcatcccacctttctcagtataatccatgagaggtgtttccaaaaggagatgagggaacaggataggtttcagaagagtcaaatgcttctaatgtctcaaggtgataaaatacaaaaactaagtagacagatatttgtactgaagtctgatacagaattagaaaaaaaaaattcttgttgaaatattttgaaaacaaattccctactatcatcacatgcctccccaaccccaagtcaaaaacaagaggaatggtactacaaacatggctttgtccattaagagctaattcatttgtttatcttagcatactagatttgggaaaatgataactcatcttttctgataattgcctatgttctaggtaacaggaaaacaggcattaagtttattttagtcttcccattttcttcctattactttattgactcattttattgcaaaacaaaaaggattacccaaacaacatgtttcgaacaaggagaattttcaatgaaatacttgattctgttaaaatgcagaggtgctataacattcaaagtgtcagattccttgggagtatggaaaacctaatggtgcttctcccttggaaatgccataggaagcccacaaccgctaacacttacaattttggtgcaaaagcaaacagttccagcaggctctctaaagaaaaactcattgtaacttattaaaataatatctggtgcaaagtatctgttttgagcttttgactaatccaagtaaaggaatatgaagggattgtaaaaaacaaaatgtccattgatagaccatcgtgtacaagtagatttctgcttgttgaatatgtaaaatagggtaattcattgacttgttttagtattttgtgtgccttagatttccgttttaagacatgtatatttttgtgagcctaaggtttcttatatacatataagtatataaataagtgattgtttattgcttcagctgcttcaacaagatatttactagtattagactatcaggaatacacccttgcgagattatgttttagattttaggccttagctcccactagaaattatttcttcaccagatttaatggataaagttttatggctctttatgcatccactcatctactcattcttcgagtctacacttattgaatgcctgcaaaatctaagtatcacttttatttttctttggatcaccacctatgacatagtaaacttgaagaataaaaactaccctcagaaatatttttaaaagaagtagcaaattatcttcagtataatccatggtaatgtatgcagtaattcaaattgatctctctctcaataggtttcttaacaatctaaacttgaaacatcaatgttaatttttggaactattgggatttgtgacgcttgttgcagtttaccaaaacaagtatttgaaaatatatagtatcaactgaaatgtttccattccgttgttgtagttaacatcatgaatggacttcttaagctgattaccccactgtgggaaccaaattggattcctactttgttggactctctttcctgattttaacaatttaccatcccattctctgccctgtgattttttttaaaagcttattcaatgttctgcagcattgtgattgtatgctggctacactgcttttagaatgctctttctcatgaagcaaggaaataaatttgtttgaaatgacattttctctca

SEQ ID NO: 190304 - DNA, 9588 bp, Homo sapiens
  Payload ID: 17595
  Gene Name: tet methylcytosine dioxygenase 2
  Uniprot ID: Q6N021
  ENST ID: ENST00000265149
  CDS Start-End: 387-3971
gcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtaggtttggacagaagggtaaagctattaggattgaaagagtcatctatactggtaaagaaggcaaaagttctcagggatgtcctattgctaagtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttggcaagtggctgttggccagagacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagaacaggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaa

SEQ ID NO: 190305 - DNA, 9233 bp, Homo sapiens
  Payload ID: 17595
  Gene Name: tet methylcytosine dioxygenase 2
  Uniprot ID: Q6N021
  ENST ID: ENST00000305737
  CDS Start-End: 405-3902
aaacagaaggtgggccggggcggggagaaacagaactcggtcaatttcccagtttgtcgggtctttaaaaatacaggcccctaaagcactaagggcatgccctcggtgaaacaggggagcgcttctgctgaatgagattaaagcgacagaaaagggaaaggagagcgcgggcaacgggatctaaagggagatagagacgcgggcctctgagggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtaggtaagtgccagaaatgtactgagacacatggcgtttatccagaattagcaaatttatcttcagatatgggattttccttctttttttaaatcttgagtctggcagcaatttgtaaaggctcataaaaatctgaagcttacattttttgtcaagttaccgatgcttgtgtcttgtgaaagagaacttcacttacatgcagtttttccaaaagaattaaataatcgtgcatgtttatttttccctctcttcagatcctgtaaaatttgaatgtatctgttttagatcaattcgcctatttagctctttgtatattatctcctggagagacagctaggcagcaaaaaaacaatctattaaaatgagaaaataacgaccataggcagtctaatgtacgaactttaaatattttttaattcaaggtaaaatatattagtttcacaagatttctggctaatagggaaattattatcttcagtcttcatgagttgggggaaatgataatgctgacactcttagtgctcctaaagtttccttttctccatttatacatttggaatgttgtgatttatattcattttgattcccttttctctaaaatttcatctttttgattaaaaaatatgatacaggcatacctcagagatattgtgggtttggctccataccacaataaaatgaatattacaataaagcaagttgtaaggactttttggtttctcactgtatgtaaaagttatttatatactatactgtaacatactaagtgtgcaatagcattgtgtctaaaaaatatatactttaaaaataatttattgttaaaaaaatgccaacaattatctgggcctttagtgagtgctaatctttttgctggtggagggtcgtgcttcagtattgatcgctgtggactgatcatggtggtagttgctgaaggttgctgggatggctgtgtgtgtggcaatttcttaaaataagacaacagtgaagtgctgtatcaattgatttttccattcacaaaagatttctctgtagcatgcaatgctgtttgatagcatttaacccacagcagaatttctttgaaaattggactcagtcctctcaaactgtgctgctgctttatcaactaagtttttgtaattttctgaatcctttgttgtcatttcagcagtttacagcatcttcattggaagtatattccatctcaaacattctttgttcatccataagaagcaacttcttatcaagttttttcatgacattgcagtaactcagccccatcttcaggctctacttctaattctggttctcttgctacatctccctcatctgcagtgacctctccacggaagtcttgaactcctcaaagtaatccatgagggttggaatcaacttctaaactcctgttaatgttgatatattgaccccctcccatgaattatgaatgttcttaataacttctaaatggtgatacctttccagaaggctttcaatgtactttgcccggatccatcagaagactatcttggcagctgtagactaacaatatatttcttaaatgataagacttgaaagtcaaaagtactccttaatccataggctgcagaatcaatgttgtattaacaggcacgaaaacagcattaatcttgtgcatctccatcggagctcttgggtgactaggtgccttgagcagtaatattttgaaaggaggttttggttttgttttttgttttttttttttgttttttagcagtaagtctcaacactgggcttaaaatattcagtaaactatgttgtaaaaagatgtgttatcatccagactttgttgttccattactctacacaagcagggtacacttagcataattcttaagggccttggaattttcagaatggtaaatgagtatgggcttcaacttaaaatcatcaactgcattagcctgtaacaagagagtcagcctgtcctttgaagcaaggcattgacttctatctatgaaagtcttagatggcaccttgtttcaatagtaggctgtttagtacagccaccttcatcagtgatcttagctagatcttctgcataacttgctgcagcttctacatcagcacttgctgcctcaccttgtccttttatgttatagagacagctgcgcttcttaaactttataaaccaacttctgctagcttccaacttctcttctgcagcttcctcattctcttcatagaactgaagggagtcaaggccttgctctggattaagctttggcttaaggaatgttgtggctgacgtgatcttctatccagaccactaaagcgctctccatatcagcaataaggccgttttgctttcttacctttcatgtgttcactggagtaatttccttcaagaatttttcctttacattcacaacttggctaactggcatgcaaggcctagctttcagcctgtcttggcttttgacatgccttcctcacttagctcgtcatatctagcttttgatttaaagtggcaggcatacaactcttcctttcacttgaacacttagaggccactgtagggttattaattggcctaatttcaatattgttgtgttttagggaatagagaggcccagggagagggagagagcccaaacggctggttgatagagcaggcagaatgcacacaacatttatcagattatgtttgcaccatttaccagattatgggtacggtttgtggcaccccccaaaaattagaatagtaacatcaaagatcactgatcacagatcgccataacataaataataataaactttaaaatactgtgagaattaccaaaatgtgatacagagacatgaagtgagcacatgctgttgaaaaaaatgacactgatagacatacttaacacgtgggattgccacaaaccttcagtttgtaaaagtcacagtaactgtgactcacaaaagaacaaagcacaataaaacgaggtatgcctgtatttttaaaaaaagctttttgttaaaattcaggatatgtaataggtctgtaggaatagtgaaatatttttgctgatggatgtagatatatacgtggatagagatgaagatcttaattatagctatgcagcatagatttagtcaaagacatttgaaaagacaaatgttaaattagtgtggctaatgacctacccgtgccatgttttccctcttgcaatgagataccccacactgtgtagaaggatggagggaggactcctactgtccctctttgcgtgtggttattaagttgcctcactgggctaaaacaccacacatctcatagataatatttggtaagttgtaatcgtcttcactcttctcttatcacccacccctatcttcccacttttccatctttgttggtttgcaacagccccttctttttgcctgactctccaggattttctctcatcataaattgttctaaagtacatactaatatgggtctggattgactattcttatttgcaaaacagcaattaaatgttatagggaagtaggaagaaaaaggggtatccttgacaataaaccaagcaatattctgggggtgggatagagcaggaaattttatttttaatcttttaaaatccaagtaataggtaggcttccagttagctttaaatgttttttttttccagctcaaaaaattggattgtagttgatactacatataatacattctaattccctcactgtattctttgtttagtttcatttatttggtttaaaataattttttatcccatatctgaaatgtaatatatttttatccaacaaccagcatgtacatatacttaattatgtggcacattttctaatagatcagtccatcaatctactcattttaaagaaaaaaaaattttaaagtcacttttagagcccttaatgtgtagttgggggttaagctttgtggatgtagcctttatatttagtataattgaggtctaaaataataatcttctattatctcaacagagcaaattattgaaaaagatgaaggtcctttttatacccatctaggagcaggtcctaatgtggcagctattagagaaatcatggaagaaaggtaattaacgcaaaggcacagggcagattaacgtttatccttttgtatatgtcagaatttttccagccttcacacacaaagcagtaaacaattgtaaattgagtaattattagtaggcttagctattctagggttgccaacactacacactgtgctattcaccagagagtcacaatatttgacaggactaatagtctgctagctggcacaggctgcccactttgcgatggatgccagaaaacccaggcatgaacaggaatcggccagccaggctgccagccacaaggtactggcacaggctccaacgagaggtcccactctggctttcccacctgataataaagtgtcaaagcagaaagactggtaaagtgtggtataagaaaagaaccactgaattaaattcacctagtgttgcaaatgagtacttatctctaagttttcttttaccataaaaagagagcaagtgtgatatgttgaatagaaagagaaacatactatttacagctgcctttttttttttttttcgctatcaatcacaggtatacaagtacttgcctttactcctgcatgtagaagactcttatgagcgagataatgcagagaaggcctttcatataaatttatacagctctgagctgttcttcttctagggtgccttttcattaagaggtaggcagtattattattaaagtacttaggatacattggggcagctaggacatattcagtatcattcttgctccatttccaaattattcatttctaaattagcatgtagaagttcactaaataatcatctagtggcctggcagaaatagtgaatttccctaagtgccttttttttgttgtttttttgttttgttttttaaacaagcagtaggtggtgctttggtcataagggaagatatagtctatttctaggactattccatattttccatgtggctggatactaactatttgccagcctccttttctaaattgtgagacattcttggaggaacagttctaactaaaatctattatgactccccaagttttaaaatagctaaatttagtaagggaaaaaatagtttatgttttagaagactgaacttagcaaactaacctgaattttgtgctttgtgaaattttatatcgaaatgagctttcccattttcacccacatgtaatttacaaaatagttcattacaattatctgtacattttgatattgaggaaaaacaaggcttaaaaaccattatccagtttgcttggcgtagacctgtttaaaaaataataaaccgttcatttctcaggatgtggtcatagaataaagttatgctcaaatgttcaaatattt

SEQ ID NO: 190306 - DNA, 9679 bp, Homo sapiens
  Payload ID: 17595
  Gene Name: tet methylcytosine dioxygenase 2
  Uniprot ID: Q6N021
  ENST ID: ENST00000380013
  CDS Start-End: 387-6395
gcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtagagcaaattattgaaaaagatgaaggtcctttttatacccatctaggagcaggtcctaatgtggcagctattagagaaatcatggaagaaaggtttggacagaagggtaaagctattaggattgaaagagtcatctatactggtaaagaaggcaaaagttctcagggatgtcctattgctaagtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttggcaagtggctgttggccagagacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagaacaggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaa

SEQ ID NO: 190307 - DNA, 4935 bp, Homo sapiens
  Payload ID: 17595
  Gene Name: tet methylcytosine dioxygenase 2
  ENST ID: ENST00000394764
  CDS Start-End: 104-2017
gaaaggagacccgactgcaactgctggattgctgcaaggctgagggacgagaacgagaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctgagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtagagcaaattattgaaaaagatgaaggtcctttttatacccatctaggagcaggtcctaatgtggcagctattagagaaatcatggaagaaaggtaattaacgcaaaggcacagggcagattaacgtttatccttttgtatatgtcagaatttttccagccttcacacacaaagcagtaaacaattgtaaattgagtaattattagtaggcttagctattctagggttgccaacactacacactgtgctattcaccagagagtcacaatatttgacaggactaatagtctgctagctggcacaggctgcccactttgcgatggatgccagaaaacccaggcatgaacaggaatcggccagccaggctgccagccacaaggtactggcacaggctccaacgagaggtcccactctggctttcccacctgataataaagtgtcaaagcagaaagactggtaaagtgtggtataagaaaagaaccactgaattaaattcacctagtgttgcaaatgagtacttatctctaagttttcttttaccataaaaagagagcaagtgtgatatgttgaatagaaagagaaacatactatttacagctgcctttttttttttttttcgctatcaatcacaggtatacaagtacttgcctttactcctgcatgtagaagactcttatgagcgagataatgcagagaaggcctttcatataaatttatacagctctgagctgttcttcttctagggtgccttttcattaagaggtaggcagtattattattaaagtacttaggatacattggggcagctaggacatattcagtatcattcttgctccatttccaaattattcatttctaaattagcatgtagaagttcactaaataatcatctagtggcctggcagaaatagtgaatttccctaagtgccttttttttgttgtttttttgttttgttttttaaacaagcagtaggtggtgctttggtcataagggaagatatagtctatttctaggactattccatattttccatgtggctggatactaactatttgccagcctccttttctaaattgtgagacattcttggaggaacagttctaactaaaatctattatgactccccaagttttaaaatagctaaatttagtaagggaaaaaatagtttatgttttagaagactgaacttagcaaactaacctgaattttgtgctttgtgaaattttatatcgaaatgagctttcccattttcacccacatgtaatttacaaaatagttcattacaattatctgtacattttgatattgaggaaaaacaaggcttaaaaaccattatccagtttgcttggcgtagacctgtttaaaaaataataaaccgttcatttctcaggatgtggtcatagaataaagttatgctcaaatgtt

SEQ ID NO: 190308 - DNA, 4973 bp, Homo sapiens
  Payload ID: 17595
  Gene Name: tet methylcytosine dioxygenase 2
  ENST ID: ENST00000413648
  CDS Start-End: 141-3644
agaaggaagcaagatggctgccctttaggatttgttagaaaggagacccgactgcaactgctggattgctgcaaggctgagggacgagaacgagaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtagagcaaattattgaaaaagatgaaggtcctttttatacccatctaggagcaggtcctaatgtggcagctattagagaaatcatggaagaaaggtaattaacgcaaaggcacagggcagattaacgtttatccttttgtatatgtcagaatttttccagccttcacacacaaagcagtaaacaattgtaaattgagtaattattagtaggcttagctattctagggttgccaacactacacactgtgctattcaccagagagtcacaatatttgacaggactaatagtctgctagctggcacaggctgcccactttgcgatggatgccagaaaacccaggcatgaacaggaatcggccagccaggctgccagccacaaggtactggcacaggctccaacgagaggtcccactctggctttcccacctgataataaagtgtcaaagcagaaagactggtaaagtgtggtataagaaaagaaccactgaattaaattcacctagtgttgcaaatgagtacttatctctaagttttcttttaccataaaaagagagcaagtgtgatatgttgaatagaaagagaaacatactatttacagctgcctttttttttttttttcgctatcaatcacaggtatacaagtacttgcctttactcctgcatgtagaagactcttatgagcgagataatgcagagaaggcctttcatataaatttatacagctctgagctgttcttcttctagggtgccttttcattaagaggtaggcagtattattattaaagtacttaggatacattggggcagctaggacatattcagtatcattcttgctccatttccaaattattcatttctaaattagcatgtagaagttcactaaataatcatctagtggcctggcagaaatagtgaatttccctaagtgccttttttttgttgtttttttgttttgttttttaaacaagcagtaggtggtgctttggtcataagggaagatatagtctatttctaggactattccatattttccatgtggctggatactaactatttgccagcctccttttctaaattgtgagacattcttggaggaacagttctaactaaaatctattatgactccccaagttttaaaatagctaaatttagtaagggaaaaaatagtttatgttttagaagactgaacttagcaaactaacctgaattttgtgctttgtgaaattttatatcgaaatgagctttcccattttcacccacatgtaatttacaaaatagttcattacaattatctgtacattttgatattgaggaaaaacaaggcttaaaaaccattatccagtttgcttggcgtagacctgtttaaaaaataataaaccgttcatttctcaggatgtggtcatagaataaagttatgctcaaatgtt

SEQ ID NO: 190309 - DNA, 10166 bp, Homo sapiens
  Payload ID: 17595
  Gene Name: tet methylcytosine dioxygenase 2
  ENST ID: ENST00000513237
  CDS Start-End: 798-6869
ccgtgccatcccaacctcccacctcgcccccaaccttcgcgcttgctctgcttcttctcccaggggtggagacccgccgaggtccccggggttcccgagggctgcacccttccccgcgctcgccagccctggcccctactccgcgctggtccgggcgcaccactccccccgcgccactgcacggcgtgagggcagcccaggtctccactgcgcgccccgctgtacggccccaggtgccgccggcctttgtgctggacgcccggtgcggggggctaattccctgggagccggggctgagggccccagggcggcggcgcaggccggggcggagcgggaggaggccggggcggagcaggaggaggcccgggcggaggaggagagccggcggtagcggcagtggcagcggcgagagcttgggcggccgccgccgcctcctcgcgagcgccgcgcgcccgggtcccgctcgcatgcaagtcacgtccgccccctcggcgcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggctggcaaacattcagcagcacaccctctcaagattgtttacttgcctttgctcctgttgagttacaacgcttggaagcaggagatgggctcagcagcagccaataggacatgatccaggaagagcaaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtagagcaaattattgaaaaagatgaaggtcctttttatacccatctaggagcaggtcctaatgtggcagctattagagaaatcatggaagaaaggtttggacagaagggtaaagctattaggattgaaagagtcatctatactggtaaagaaggcaaaagttctcagggatgtcctattgctaagtgggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagagaacttgcgcctgtcaggggctggatccagaaacctgtggtgcctccttctcttttggttgttcatggagcatgtactacaatggatgtaagtttgccagaagcaagatcccaaggaagtttaagctgcttggggatgacccaaaagaggaagagaaactggagtctcatttgcaaaacctgtccactcttatggcaccaacatataagaaacttgcacctgatgcatataataatcagattgaatatgaacacagagcaccagagtgccgtctgggtctgaaggaaggccgtccattctcaggggtcactgcatgtttggacttctgtgctcatgcccacagagacttgcacaacatgcagaatggcagcacattggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatgctattttatggatcataggctcttcagagaactgaatggcagtctgcctttgtgttgataattatgtacattgtgacgttgtcatttcttagcttaagtgtcctctttaacaagaggattgagcagactgatgcctgcataagatgaataaacagggttagttccatgtgaatctgtcagttaaaaagaaacaaaaacaggcagctggtttgctgtggtggttttaaatcattaatttgtataaagaagtgaaagagttgtatagtaaattaaattgtaaacaaaacttttttaatgcaatgctttagtattttagtactgtaaaaaaattaaatatatacatatatatatatatatatatatatatatatatgagtttgaagcagaattcacatcatgatggtgctactcagcctgctacaaatatatcataatgtgagctaagaattcattaaatgtttgagtgatgttcctacttgtcatatacctcaacactagtttggcaataggatattgaactgagagtgaaagcattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttggcaagtggctgttggccagagacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagaacaggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaagtgttgtcttcct

SEQ ID NO: 190310 - DNA, 865 bp, Homo sapiens
  Payload ID: 17595
  Gene Name: tet methylcytosine dioxygenase 2
  ENST ID: ENST00000514870
  CDS Start-End: 536-865
atcagctgtagggtctgggtctgggtttgtgtctgcctcctcctaccttcttatccccctttagggggctgtacgaagtgaatgtcacagggagtggaattggagtacactgagtgggttttttttttccttaagtccgcgcgttttgttagcggcgctgagtgaaagaggaaagaatagtttctctggttccccaaacaagaccagaactcacttttctcaaggtacataagtcagcgctgggctgagccttccagcctggggaatgtatgtaagagaatttatggacaaatctgtgtcccggctttgtgcttctcccgaatcagcttcgtttggttccttggctggcaaacattcagcagcacaccctctcaagattgtttacttgcctttgctcctgttgagttacaacgcttggaagcaggagatgggctcagcagcagccaataggacatgatccaggaagagcagtaagggactgagctgctgaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaag

SEQ ID NO: 190311 - DNA, 10166 bp, Homo sapiens; identical to SEQ ID NO: 190309
  Payload ID: 17595
  Gene Name: tet methylcytosine dioxygenase 2
  Uniprot ID: Q6N021
  ENST ID: ENST00000540549
  CDS Start-End: 861-6869

SEQ ID NO: 190312 - DNA, 5174 bp, Homo sapiens
  Payload ID: 17596
  Gene Name: tet methylcytosine dioxygenase 3
  ENST ID: ENST00000305799
  CDS Start-End: 66-5174
cctcctctgcagtgcctccctccgtgcgctccctccggcggggataatgggaggcccgccggccgatgcaccagaggaggccggccgaggtggaaataaaggctggtgaaggagccgggccgtggggacaaggagcggctgtcaagacaggctcagagctcagcccagttgatggacctgttccaggtcagatggactcagggccagtgtaccatggggactcacggcagctaagcgcctcaggggtgccggtcaatggtgctagagagcccgctggacccagtctgctggggactgggggtccttggcgggtagaccaaaagcccgactgggaggctgccccaggcccagctcatactgctcgcctggaagatgcccacgatctggtggccttttcggctgtggccgaagctgtgtcctcttatggggcccttagcacccggctctatgaaaccttcaaccgtgagatgagtcgtgaggctgggaacaacagcaggggaccccggccagggcctgagggctgctctgctggcagcgaagaccttgacacactgcagacggccctggccctcgcgcggcatggtatgaaaccacccaactgcaactgcgatggcccagaatgccctgactacctcgagtggctggaggggaagatcaagtctgtggtcatggaaggaggggaggagcggcccaggctcccagggcctctgcctcctggtgaggccggcctcccagcaccaagcaccaggccactcctcagctcagaggtgccccagatctctccccaagagggcctgcccctgtcccagagtgccctgagcattgccaaggaaaaaaacatcagcttgcagaccgccattgccattgaggccctcacacagctctcctctgccctcccgcagccttctcattccaccccccaggcttcttgcccccttcctgaggccttgtcacctcctgcccctttcagatctccccagtcttacctccgggctccctcatggcctgtggttcctcctgaagagcactcatcttttgctcctgatagctctgccttccctccagcaactcctagaactgagttccctgaagcctggggcactgacacccctccagcaacgccccggagctcctggcccatgcctcgcccaagccccgatcccatggctgaactggagcagttgttgggcagcgccagtgattacatccagtcagtattcaagcggcctgaggccctgcctaccaagcccaaggtcaaggtggaggcaccctcttcctccccggccccggccccatcccctgtacttcagagggaggctcccacgccatcctcggagcccgacacccaccagaaggcccagaccgccctgcagcagcacctccaccacaagcgcagcctcttcctagaacaggtgcacgacacctccttccctgctccttcagagccttctgctcctggctggtggcccccaccaagttcacctgtcccacggcttccagacagaccacccaaggagaagaagaagaagctcccaacaccagctggaggtcccgtgggaacggagaaagctgcccctgggatcaagcccagtgtccgaaagcccattcagatcaagaagtccaggccccgggaagcacagcccctcttcccacctgtccgacagattgtcctggaagggcttaggtccccagcctcccaggaagtgcaggctcatccaccggcccctctgcctgcctcacagggctctgctgtgcccctgcccccagaaccttctcttgcgctatttgcacctagtccctccagggacagcctgctgccccctactcaggaaatgaggtcccccagccccatgacagccttgcagccaggctccactggccctcttccccctgccgatgacaagctggaagagctcatccggcagtttgaggctgaatttggagatagctttgggcttcccggccccccttctgtgcccattcaggaccccgagaaccagcaaacatgtctcccagcccctgagagcccctttgctacccgttcccccaagcaaatcaagattgagtcttcgggggctgtgactgtgctctcaaccacctgcttccattcagaggagggaggacaggaggccacacccaccaaggctgagaacccactcacacccaccctcagtggcttcttggagtcacctcttaagtacctggacacacccaccaagagtctgctggacacacctgccaagagagcccaggccgagttccccacctgcgattgcgtcgaacaaatagtggagaaagatgaaggtccatattatactcacttgggatctggccccacggtcgcctctatccgggaactcatggaggagcggtatggagagaaggggaaagccatccggatcgagaaggtcatctacacggggaaggagggaaagagctcccgcggttgccccattgcaaagtgggtgatccgcaggcacacgctggaggagaagctactctgcctggtgcggcaccgggcaggccaccactgccagaacgctgtgatcgtcatcctcatcctggcctgggagggcattccccgtagcctcggagacaccctctaccaggagctcaccgacaccctccggaagtatgggaaccccaccagccggagatgcggcctcaacgatgaccggacctgcgcttgccaaggcaaagaccccaacacctgtggtgcctccttctcctttggttgttcctggagcatgtacttcaacggctgcaagtatgctcggagcaagacacctcgcaagttccgcctcgcaggggacaatcccaaagaggaagaagtgctccggaagagtttccaggacctggccaccgaagtcgctcccctgtacaagcgactggcccctcaggcctatcagaaccaggtgaccaacgaggaaatagcgattgactgccgtctggggctgaaggaaggacggcccttcgcgggggtcacggcctgcatggacttctgtgcccacgcccacaaggaccagcataacctctacaatgggtgcaccgtggtctgcaccctgaccaaggaagacaatcgctgcgtgggcaagattcccgaggatgagcagctgcatgttctccccctgtacaagatggccaacacggatgagtttggtagcgaggagaaccagaatgcaaaggtgggcagcggagccatccaggtgctcaccgccttcccccgcgaggtccgacgcctgcccgagcctgccaagtcctgccgccagcggcagctggaagccagaaaggcagcagccgagaagaagaagattcagaaggagaagctgagcactccggagaagatcaagcaggaggccctggagctggcgggcattacgtcggacccaggcctgtctctgaagggtggattgtcccagcaaggcctgaagccctccctcaaggtggagccgcagaaccacttcagctccttcaagtacagcggcaacgcggtggtggagagctactcggtgctgggcaactgccggccctccgacccttacagcatgaacagcgtgtactcctaccactcctactatgcacagcccagcctgacctccgtcaatggcttccactccaagtacgctctcccgtcttttagctactatggctttccatccagcaaccccgtcttcccctctcagttcctgggtcctggtgcctgggggcacagtggcagcagtggcagttttgagaagaagccagacctccacgctctgcacaacagcctgagcccggcctacggtggtgctgagtttgccgagctgcccagccaggctgttcccacagacgcccaccaccccactcctcaccaccagcagcctgcgtacccaggccccaaggagtatctgcttcccaaggcccccctactccactcagtgtccagggacccctccccctttgcccagagctccaactgctacaacagatccatcaagcaagagccagtagacccgctgacccaggctgagcctgtgcccagagacgctggcaagatgggcaagacacctctgtccgaggtgtctcagaatggaggacccagtcacctttggggacagtactcaggaggcccaagcatgtcccccaagaggactaacggtgtgggtggcagctggggtgtgttctcgtctggggagagtcctgccatcgtccctgacaagctcagttcctttggggccagctgcctggccccttcccacttcacagatggccagtgggggctgttccccggtgaggggcagcaggcagcttcccactctggaggacggctgcgaggcaaaccgtggagcccctgcaagtttgggaacagcacctcggccttggctgggcccagcctgactgagaagccgtgggcgctgggggcaggggatttcaactcggccctgaaaggtagtcctgggttccaagacaagctgtggaaccccatgaaaggagaggagggcaggattccagccgcaggggccagccagctggacagggcctggcagtcctttggtctgcccctgggatccagcgagaagctgtttggggctctgaagtcagaggagaagctgtgggaccccttcagcctggaggaggggccggctgaggagccccccagcaagggagcggtgaaggaggagaagggcggtggtggtgcggaggaggaagaggaggagctgtggtcggacagtgaacacaacttcctggacgagaacatcggcggcgtggccgtggccccagcccacggctccatcctcatcgagtgtgcccggcgggagctgcacgccaccacgccgcttaagaagcccaaccgctgccaccccacccgcatctcgctggtcttctaccagcacaagaacctcaaccagcccaaccacgggctggccctctgggaagccaagatgaagcagctggcggagagggcacgggcacggcaggaggaggctgcccggctgggcctgggccagcaggaggccaagctctacgggaagaagcgcaagtgggggggcactgtggttgctgagccccagcagaaagagaagaagggggtcgtccccacccggcaggcactggctgtgcccacagactcggcggtcaccgtgtcctcctatgcctacacgaaggtcactggcccctacagccgctggatctag

SEQ ID NO: 190313 - DNA, 11388 bp, Homo sapiens
  Payload ID: 17596
  Gene Name: tet methylcytosine dioxygenase 3
  Uniprot ID: O43151
  ENST ID: ENST00000409262
  CDS Start-End: 1-5388
atgagccagtttcaggtgcccctggccgtccagccggacctgccaggcctttatgacttccctcagcgccaggtgatggtagggagcttcccggggtctgggctctccatggctgggagtgagtcccaactccgagggggtggagatggtcgaaagaaacggaaacggtgtggtacttgtgagccctgccggcggctggaaaactgtggcgcttgcactagctgtaccaaccgccgcacgcaccagatctgcaaactgcgaaaatgtgaggtgctgaagaaaaaagtagggcttctcaaggaggtggaaataaaggctggtgaaggagccgggccgtggggacaaggagcggctgtcaagacaggctcagagctcagcccagttgatggacctgttccaggtcagatggactcagggccagtgtaccatggggactcacggcagctaagcgcctcaggggtgccggtcaatggtgctagagagcccgctggacccagtctgctggggactgggggtccttggcgggtagaccaaaagcccgactgggaggctgccccaggcccagctcatactgctcgcctggaagatgcccacgatctggtggccttttcggctgtggccgaagctgtgtcctcttatggggcccttagcacccggctctatgaaaccttcaaccgtgagatgagtcgtgaggctgggaacaacagcaggggaccccggccagggcctgagggctgctctgctggcagcgaagaccttgacacactgcagacggccctggccctcgcgcggcatggtatgaaaccacccaactgcaactgcgatggcccagaatgccctgactacctcgagtggctggaggggaagatcaagtctgtggtcatggaaggaggggaggagcggcccaggctcccagggcctctgcctcctggtgaggccggcctcccagcaccaagcaccaggccactcctcagctcagaggtgccccagatctctccccaagagggcctgcccctgtcccagagtgccctgagcattgccaaggaaaaaaacatcagcttgcagaccgccattgccattgaggccctcacacagctctcctctgccctcccgcagccttctcattccaccccccaggcttcttgcccccttcctgaggccttgtcacctcctgcccctttcagatctccccagtcttacctccgggctccctcatggcctgtggttcctcctgaagagcactcatcttttgctcctgatagctctgccttccctccagcaactcctagaactgagttccctgaagcctggggcactgacacccctccagcaacgccccggagctcctggcccatgcctcgcccaagccccgatcccatggctgaactggagcagttgttgggcagcgccagtgattacatccagtcagtattcaagcggcctgaggccctgcctaccaagcccaaggtcaaggtggaggcaccctcttcctccccggccccggccccatcccctgtacttcagagggaggctcccacgccatcctcggagcccgacacccaccagaaggcccagaccgccctgcagcagcacctccaccacaagcgcagcctcttcctagaacaggtgcacgacacctccttccctgctccttcagagccttctgctcctggctggtggcccccaccaagttcacctgtcccacggcttccagacagaccacccaaggagaagaagaagaagctcccaacaccagctggaggtcccgtgggaacggagaaagctgcccctgggatcaagcccagtgtccgaaagcccattcagatcaagaagtccaggccccgggaagcacagcccctcttcccacctgtccgacagattgtcctggaagggcttaggtccccagcctcccaggaagtgcaggctcatccaccggcccctctgcctgcctcacagggctctgctgtgcccctgcccccagaaccttctcttgcgctatttgcacctagtccctccagggacagcctgctgccccctactcaggaaatgaggtcccccagccccatgacagccttgcagccaggctccactggccctcttccccctgccgatgacaagctggaagagctcatccggcagtttgaggctgaatttggagatagctttgggcttcccggccccccttctgtgcccattcaggaccccgagaaccagcaaacatgtctcccagcccctgagagcccctttgctacccgttcccccaagcaaatcaagattgagtcttcgggggctgtgactgtgctctcaaccacctgcttccattcagaggagggaggacaggaggccacacccaccaaggctgagaacccactcacacccaccctcagtggcttcttggagtcacctcttaagtacctggacacacccaccaagagtctgctggacacacctgccaagagagcccaggccgagttccccacctgcgattgcgtcgaacaaatagtggagaaagatgaaggtccatattatactcacttgggatctggccccacggtcgcctctatccgggaactcatggaggagcggtatggagagaaggggaaagccatccggatcgagaaggtcatctacacggggaaggagggaaagagctcccgcggttgccccattgcaaagtgggtgatccgcaggcacacgctggaggagaagctactctgcctggtgcggcaccgggcaggccaccactgccagaacgctgtgatcgtcatcctcatcctggcctgggagggcattccccgtagcctcggagacaccctctaccaggagctcaccgacaccctccggaagtatgggaaccccaccagccggagatgcggcctcaacgatgaccggacctgcgcttgccaaggcaaagaccccaacacctgtggtgcctccttctcctttggttgttcctggagcatgtacttcaacggctgcaagtatgctcggagcaagacacctcgcaagttccgcctcgcaggggacaatcccaaagaggaagaagtgctccggaagagtttccaggacctggccaccgaagtcgctcccctgtacaagcgactggcccctcaggcctatcagaaccaggtgaccaacgaggaaatagcgattgactgccgtctggggctgaaggaaggacggcccttcgcgggggtcacggcctgcatggacttctgtgcccacgcccacaaggaccagcataacctctacaatgggtgcaccgtggtctgcaccctgaccaaggaagacaatcgctgcgtgggcaagattcccgaggatgagcagctgcatgttctccccctgtacaagatggccaacacggatgagtttggtagcgaggagaaccagaatgcaaaggtgggcagcggagccatccaggtgctcaccgccttcccccgcgaggtccgacgcctgcccgagcctgccaagtcctgccgccagcggcagctggaagccagaaaggcagcagccgagaagaagaagattcagaaggagaagctgagcactccggagaagatcaagcaggaggccctggagctggcgggcattacgtcggacccaggcctgtctctgaagggtggattgtcccagcaaggcctgaagccctccctcaaggtggagccgcagaaccacttcagctccttcaagtacagcggcaacgcggtggtggagagctactcggtgctgggcaactgccggccctccgacccttacagcatgaacagcgtgtactcctaccactcctactatgcacagcccagcctgacctccgtcaatggcttccactccaagtacgctctcccgtcttttagctactatggctttccatccagcaaccccgtcttcccctctcagttcctgggtcctggtgcctgggggcacagtggcagcagtggcagttttgagaagaagccagacctccacgctctgcacaacagcctgagcccggcctacggtggtgctgagtttgccgagctgcccagccaggctgttcccacagacgcccaccaccccactcctcaccaccagcagcctgcgtacccaggccccaaggagtatctgcttcccaaggcccccctactccactcagtgtccagggacccctccccctttgcccagagctccaactgctacaacagatccatcaagcaagagccagtagacccgctgacccaggctgagcctgtgcccagagacgctggcaagatgggcaagacacctctgtccgaggtgtctcagaatggaggacccagtcacctttggggacagtactcaggaggcccaagcatgtcccccaagaggactaacggtgtgggtggcagctggggtgtgttctcgtctggggagagtcctgccatcgtccctgacaagctcagttcctttggggccagctgcctggccccttcccacttcacagatggccagtgggggctgttccccggtgaggggcagcaggcagcttcccactctggaggacggctgcgaggcaaaccgtggagcccctgcaagtttgggaacagcacctcggccttggctgggcccagcctgactgagaagccgtgggcgctgggggcaggggatttcaactcggccctgaaaggtagtcctgggttccaagacaagctgtggaaccccatgaaaggagaggagggcaggattccagccgcaggggccagccagctggacagggcctggcagtcctttggtctgcccctgggatccagcgagaagctgtttggggctctgaagtcagaggagaagctgtgggaccccttcagcctggaggaggggccggctgaggagccccccagcaagggagcggtgaaggaggagaagggcggtggtggtgcggaggaggaagaggaggagctgtggtcggacagtgaacacaacttcctggacgagaacatcggcggcgtggccgtggccccagcccacggctccatcctcatcgagtgtgcccggcgggagctgcacgccaccacgccgcttaagaagcccaaccgctgccaccccacccgcatctcgctggtcttctaccagcacaagaacctcaaccagcccaaccacgggctggccctctgggaagccaagatgaagcagctggcggagagggcacgggcacggcaggaggaggctgcccggctgggcctgggccagcaggaggccaagctctacgggaagaagcgcaagtgggggggcactgtggttgctgagccccagcagaaagagaagaagggggtcgtccccacccggcaggcactggctgtgcccacagactcggcggtcaccgtgtcctcctatgcctacacgaaggtcactggcccctacagccgctggatctaggtgccagggagccagcgtacctcagcgtcgggcctggcccgagctgtctctgtggtgcttttgccctcatacctgggggcgggttgggggtgcagaagtctttttatctctatatacatatatagatgcgcatatcatatatatgtatttatggtccaaacctcagaactgacccgcccctcccttacccccacttccccagcactttgaagaagaaactacggctgtcgggtgatttttccgtgatcttaatatttatatctccaagttgtcccccccccttgtctggggggtttttatttttattttctctttgtttttaaaactctatccttgtatatcacaataatggaaagaaagtttatagtatcctttcacaaaggagtagttttaaattccatttaaaatgtgtatttattggattttttaaaagcgacaatagtaatggtaaaggatgggcaggaaaggccagtagtgctcccccgcccagtctcgctgggtctggcgagccaagcccctcgggcgctggcgaggtcctcagccatctgcccctcgagagccaagcgcggacggtagccacccagttcatccctcccgacatacaccccttccctttggggaagggagcctcaggacagcttctgtcctctctgataggatgggagagtctgcagaaaaccatctggggtcccttttccagtccccggcttggagtcgaagggcagatgcaccccaggccagccccacgagatgctggcatagctttccccagaaaccaggttggaagtagatggcttcaagcttgctagtctccacactgaatcctctgtccgttatttatggagtcacacgatgtcatggttcactaggcagcacctcacgctggagctggagtgcgaggttcttaggggccgtgcccaccatgttgccaagccaatgcatgctgagctgaaggaatttgtcttagtggcagttttttaaaaaatgcccccaaagtctatgctgatactgaaaaagggctactgtatctttaaaaacaggaagttgaacccaagctgtgaaaagccagtggtgctctgtgcatggtgctgtgcggagcctggtgctgtagtgttgtgctgggactttcttgactcttgggcaggtcacatcctacaggagctcagcagaccagtgtaacaacagttaatgcatctatcctgatccctgaatttccacattggacaatggtgcatgcctcacacctgagcctgcttcctccatgctgtcattgggttcgggggcctacacttaacaattttaaagtgcaagagtcaaacattttcaacaggttgctataattttcctccctaattggtgccatttctccatttgatcattttctttttttcctttctcccctcttcatccactttaatatagctgttctgaaattctggtgcattcattcggttctttgaaatgagaatgtggtgcttaatttttgtgacgttgtcgagagaggttgggcctgatgggagcaacactcatcatcaccaagtcaaactttgttggagtgttggtttttcttgtgatattagcagaaatgatctcatgctagccatgtggatgtgtgtgtggtgaatggggggcttcatcaggacacacagaggggaatgtggccacacggtggatgaccaccaagccctgagatgaacaggtatttactgagcagttgtattcagatatgggtcttcatgaatcatgtttaacaatcagatgaccgctataggcaagttcctgagcttccgggtgccttgagtaagagctgagaaccggcctgctgggtgtttactgtatctgtttggaagcactggcggagggtcgttgtaagatgtcctgagcatttatgtggtctggttttaactgtaaatagtgaaagatttttttaagcacttttgcctagatttaaacagcaacttgaaaaaaaaagtatgttttaacatgtaattgtgggagaaattgtaaatagtagccgaatatttaatgtgctttgtctatcctccacttttaccatattctgtaaagttgcatttattttacaggacaaaaaaatgaaatattattgcttttgaaataaatacccaagagcttatcaggacttagaattattcagaactcagatttataggaaaacctctgaccttcagtttgacaagctaaaggaagcagagtctttaatgagcatgctaattttctagttttgaggaaaaattgggtcctttaaatgctattttgcttatcgcatcagtacttttatgcaggtctcatttgactccgtgcttaggtagatgcgggggtgccttgaaaacttcattttaaatgatcttaagcaagaaatacaatattttacgaaacatttggagaatgtgaccgtctgtatgacccgtggaagccccaggttggctgttggtttggaaggtcccgagtgtaacccaggtgattctgatacttggcatgtgtgaatcttcctgatgtatgttaaataaactcttcccctcatcaccctttggtaggaaagccattagatgaaaggagaaaccaatacaagctaaaagcatgcgacgtctgtcccccagcccaaacagccttggttcatcagtttctgcagtaggagataggctgctgagaggtgagtcaagaggcagtctccattggatgtccccactccccgcagaatggcgtttccagagttaggcggtgtggttgccgtgctcaagcccatgctgatttgtacactacatgtctaacctacctcaaatctcagtcattaaaattagcatgctttagacatatatttaaaaagtaactatgcacagctctttatcccccccttgctgctgaagctttcttaaagagaaaaatcaaatttttattttttactggcactatcattttttaagtcctaaagatgattaacagacatttttatcatgagaagaaaaataaagccattgcaactaaagaacctaacagcatgaccaagttcgaagagtcatattatagcaacggaaatcgatggcgtcttagtcatctccccagtgtgccctgtccacggacaccatccacgtgcagtgcaaacatttggttccttttctgctctgttttgttttccctgcctgttgcgtgcaagggaagtgcttgtaaagttctgtgctacgagatttttaaaataaaaatcgcttcgcagcaggttctcacaaaataactggtgctagctcaagaaatcatcatctgaccatcagaaatcttgactaaaggtgttgcatggatttgggggtctttcggtttttggttttgggtctggcttttagcagggccaatgtttcccacaccccggcttcatgggtactgctttgccttctcaccaaggtgacgatggtgtgcgtggaaagagatgataccccaccgccccctcttggtccttccaccagcctcttttgggaacagtagtttgcagagcaagggatttttaaagcgctaaagcaaggaaagaagtagcagagcttaactgctttgtaccacacagcagtagatgtgcaaggacggttgacaatgagtcgatgataacctaatttcattgagagaaacccagccagacttgcttctagaggtttaatcaccatgagatctcaaaccaaggcaaagctggtggaaaactatatgatatccctgacgtgcctcaaccagtatctctttccttttgttactgaagtgtgttttatggactaggaagcatttttatgaattgaaatagtctaaataaaatggtgctatggtgttttaatgtgactgtccctgatcctgtcttgctgaggtgctatcaacgttctgaaaccacaaccaaccaaaaacaaggtgggctccagtctcttggcttttttttttccctcccctcttttggtgctgtcttagacccgtttaccgtgctataatctgctctgagcagtgttgtgttgtgttgtattgttcttcccttggtggccaaacaaagcaagtcgagaaggcagctatctccctttctgtgatcgggagtgggcctgcctggcttggcaggtgctttttggttccacacctgtcttctcaggcttgatgtgaaagaaagggcgaagggttttttgagtttttgtttttgaggaaggggagttgggtacttctgcctctcctagcatgataggcattctcatagccagggacagattttctcctgcagcccagggtgctaagcagacatctctgggagtcccaagggcacaccaagggagaccagatggatctccttcctcccctggcactggctgggaccatggtgggcaggggcttcattctctgacccagcgttgcttctgcctctcattggtaaccccttatgttcggactaaaggaaggagctttctttgctcactcgatgccactgaggctgctttttagttggtgctaacctaaatttcttcttgggtccacagaagttgatgttttaaaaactcaccaggaagctccattttgtgtcatccactgtcacaataatttttttaaatacctcaaaaacaggacatcatgacaacttcagtaaagtagattccatgagggtctgatacctgcaggttgtccgtctgatgacatacttgaccttgaaaaatctggggtcattttgtttttcattcttcagcagttaagatagcggaacgccgaaaggaaggagcgtagttggctgtatttcatgtttaagttttgcttttgaataaaatgtgaatttcctatgcccatctcattgagctttctcagtcattgttgctgtcatttgaaatgactccctcaaaacctagttttattagccagctgcctctgctgtagtacatggccaacttcaacataccctggaccaaaacatttttgaggtgcatacccccaacataagttacacagtcccacatccaggtgcacagagtgcgagtgcactccgcgagtgcggggggaggggcggccccctctggtgctcccagcccttcctcctgcagagctgcaggcaagagcagagcaataggcttctcccctgagcagagaccgcagcacagaaatgcaaggtctaaagttgctttttgcctaagaatcagcgagcgatttggcctacttcctcattggcttctattctgatatcagggatgctttttgtagtggtattgtttgctccctcttcgcgttttgactacccgtcattcaggggtaactcatcactcttcacacggggatttaaattaagaaactaattggctcatgtgaacattccaaattttcttggtttcaatacccttttttttcttttgaggggaaaagaggggagaaaaacaggagtgatgtcatttctttttcatgtattccaattaaagaaacaagggcaggtcgtataatggcatattaatacattagacttaatctagaacccctgtagctttttgatgtgttttatttcttatctctttgaattcctgtttggttacttggcttccaatggaggtgaacttaacaaccatacttgaatattccgtcttgactttgtaaactgtggctacttgaaatgaagtttatctggggttgatggatgaatggtagatttttgcaatgtctcaaggcaataggatgtgtattaaactgtagatattcttagtacagtaaatttatgctgataattttattttgtataatttttacctttttgttaatattttttccttccactttattggtttgcctcctgagctacccctccttaccctcccttctccctcagtgtttcagtaaatttaatttagggtgcctagaaattgcaagtatgtatcctttttgatttgtattttattataatttacacaaacaactgggtttgtgaactgtattactcctggtatctttaaaatattgtgggtgttttaataaattttatatttattttttgcactcaaa

SEQ ID NO: 190314 - DNA, 1924 bp, Homo sapiens
  Payload ID: 17597
  Gene Name: tetra-peptide repeat homeobox 1
  Uniprot ID: Q8N7U7
  ENST ID: ENST00000322175
  CDS Start-End: 157-1392
tccctcccacccccaggccctcccctggccctggaccctccaaggagacagcggcaggagcgcacggtctacactgaaagccagcagaaagtgctagaattttactttcagaaggaccagtacccgaactacgaccagcgactgaatctggcggagatgctcagcctcagggagcaacagctgcaggtgtggttcaagaatcgccgcgccaaactagctcgggagcggcggctccagcagcagccccagcgcgtccctgggcagagaggccgaggagcccgcgctgcgcccctagtccctgcagcctctgcctccgcacctcagcggggcccctcgggaatccttccagcggcggaacccacgatctgcagcctccaccaggcctggggtggccctgggtgcagagcccagaagggcatcccagctgccctgagtccaggccctggcccgatccctgccccaatcccaggcccagcccagatcccaggcccactccctggctcaattccaggcccaattccaggcccagctcagatcccaagcccgatcccagccccaatcccaggcccaatttcaggcccagtccagatcccaggcccattccgtggcccaatcccaggcccaatttcaggcccagccccgatcccaggcccaatctcaggcccattctcaggcccaaacccaggcccgatcccaggcccaaacccaggcccgatcccaggcccaatctcaggcccgatcccaggcccaatctcagtcccgatcccaggcccgatcccaggcccaatctcaggcccaatctcaggcccaaacccaggcccgatcccaggcccaatcccaggcccaatctcaggcccgaacccaggcccgatcccaggcccaatctcaggcccgaacccaggcctgatcccaggcccaatcccaggcccaatctcaggcccaggcccaattataggcccgattcccagcccagcccagatcccaggcccaggcagactccaaggcccaggtcccatcttaagtcctggccggatgcgaagccctggctcacttccaggcctagccccgattttaggcccaggctcaggcccaggctcaggctcagtcccagctccaatcccaggcccaggatcactcccagccccagcccccttatggcctcagagccccgatgcctccgacttcttgccagacacccagttattccctcacttcacagagctgctcctacccctagaccccttggagggatcctcagtctccaccatgacctctcagtaccaagaaggggatgactctatgggcaaaaaacactcagggtctcagccccaagaggagggtggctctgtgaatgaaaatcactcaggccccaggttattactggatttatagggggcctgtgcctgcaaagttcttcagatcccagagggcctggagtggctgatctacactgctggtgactttctgcagtgaatgcatcaccctttacccaccctgctgcaggtggacatttgctgtcttcactgtgcagctatcacaggtggctctgctgtgaatgtgcctgcctgtcatttgaattgagcctgagcgtttctctgctgggattggagtcgctgctcactgggatatctggcattagtggatgctgctcgagagctttctaaagggcttttcccagggcttctgatggtcagcatcttccccaacacttaggattgtgagactttttaatgtttgtcgatccaatgacttgtggttttgttgtggttgtaatatccatttccctgatgattgagaagttaaaccctcacatgttaattgaaccttagatatcttcataatgtgtatttgtttaccccttttccttcatttatttgaatgtattcttatattctcttggcaattaaagttctgcagacacctt

SEQ ID NO: 190315 - DNA, 1526 bp, Homo sapiens
  Payload ID: 17597
  Gene Name: tetra-peptide repeat homeobox 1
  ENST ID: ENST00000543508
  CDS Start-End: 26-1231
cgaccagcgactgaatctggcggagatgctcagcctcagggagcaacagctgcaggtgtggttcaagaatcgccgcgccaaactagctcgggagcggcggctccagcagcagccccagcgcgtccctgggcagagaggccgaggagcccgcgctgcgcccctagtccctgcagcctctgcctccgcacctcagcggggcccctcgggaatccttccagcggcggaacccacgatctgcagcctccaccaggcctggggtggccctgggtgcagagcccagaagggcatcccagctgccctgagtccaggccctggcccgatccctgccccaatcccaggcccagcccagatcccaggcccactccctggctcaattccaggcccaattccaggcccagctcagatcccaagcccgatcccagccccaatcccaggcccaatttcaggcccagtccagatcccaggcccattccgtggcccaatcccaggcccaatctcaggcccattctcaggcccaaacccaggcccgatcccaggcccaaacccaggcccgatcccaggcccaatctcaggcccgatcccaggcccaatctcagtcccgatcccaggcccgatcccaggcccaatctcaggcccaatctcaggcccaaacccaggcccgatcccaggcccaatcccaggcccaatctcaggcccgaacccaggcccgatcccaggcccaatctcaggcccgaacccaggcctgatcccaggcccaatcccaggcccaatctcaggcccaggcccaattataggcccgattcccagcccagcccagatcccaggcccaggcagactccaaggcccaggtcccatcttaagtcctggccggatgcgaagccctggctcacttccaggcctagccccgattttaggcccaggctcaggcccaggctcaggctcagtcccagctccaatcccaggcccaggatcactcccagccccagcccccttatggcctcagagccccgatgcctccgacttcttgccagacacccagttattccctcacttcacagagctgctcctacccctagaccccttggagggatcctcagtctccaccatgacctctcagtaccaagaaggggatgactctatgggcaaaaaacactcagggtctcagccccaagaggagggtggctctgtgaatgaaaatcactcaggccccaggttattactggatttatagggggcctgtgcctgcaaagttcttcagatcccagagggcctggagtggctgatctacactgctggtgactttctgcagtgaatgcatcaccctttacccaccctgctgcaggtggacatttgctgtcttcactgtgcagctatcacaggtggctctgctgtgaatgtgcctgcctgtcatttgaattgagcctgagcgtttctctgctgggattggagtcgctgctcactgggatatctggcattagtggatgctgctcgagagctttctaaagggcttttcccagggcttctga

SEQ ID NO: 190316 - DNA, 2059 bp, Homo sapiens
  Payload ID: 17597
  Gene Name: tetra-peptide repeat homeobox 1
  ENST ID: ENST00000535759
  CDS Start-End: 1-1527
atggatgaagctggaaaccatcattctgagcaaactatcacaaggacagaaaaccaaacaccgcatgctctcgctcataggaggatggggccctgtctgtcttgttctcagctgtattcccagtacctaggactgtcccagacacacagcagccctcccctggccctggaccctccaaggagacagcggcaggagcgcacggtctacactgaaagccagcagaaagtgctagaattttactttcagaaggaccagtacccgaactacgaccagcgactgaatctggcggagatgctcagcctcagggagcaacagctgcaggtgtggttcaagaatcgccgcgccaaactagctcgggagcggcggctccagcagcagccccagcgcgtccctgggcagagaggccgaggagcccgcgctgcgcccctagtccctgcagcctctgcctccgcacctcagcggggcccctcgggaatccttccagcggcggaacccacgatctgcagcctccaccaggcctggggtggccctgggtgcagagcccagaagggcatcccagctgccctgagtccaggccctggcccgatccctgccccaatcccaggcccagcccagatcccaggcccactccctggctcaattccaggcccaattccaggcccagctcagatcccaagcccgatcccagccccaatcccaggcccaatttcaggcccagtccagatcccaggcccattccgtggcccaatcccaggcccaatttcaggcccagccccgatcccaggcccaatctcaggcccattctcaggcccaaacccaggcccgatcccaggcccaaacccaggcccgatcccaggcccaatctcaggcccgatcccaggcccaatctcagtcccgatcccaggcccgatcccaggcccaatctcaggcccaatctcaggcccaaacccaggcccgatcccaggcccaatcccaggcccaatctcaggcccgaacccaggcccgatcccaggcccaatctcaggcccgaacccaggcctgatcccaggcccaatcccaggcccaatctcaggcccaggcccaattataggcccgattcccagcccagcccagatcccaggcccaggcagactccaaggcccaggtcccatcttaagtcctggccggatgcgaagccctggctcacttccaggcctagccccgattttaggcccaggctcaggcccaggctcaggctcagtcccagctccaatcccaggcccaggatcactcccagccccagcccccttatggcctcagagccccgatgcctccgacttcttgccagacacccagttattccctcacttcacagagctgctcctacccctagaccccttggagggatcctcagtctccaccatgacctctcagtaccaagaaggggatgactctatgggcaaaaaacactcagggtctcagccccaagaggagggtggctctgtgaatgaaaatcactcaggccccaggttattactggatttatagggggcctgtgcctgcaaagttcttcagatcccagagggcctggagtggctgatctacactgctggtgactttctgcagtgaatgcatcaccctttacccaccctgctgcaggtggacatttgctgtcttcactgtgcagctatcacaggtggctctgctgtgaatgtgcctgcctgtcatttgaattgagcctgagcgtttctctgctgggattggagtcgctgctcactgggatatctggcattagtggatgctgctcgagagctttctaaagggcttttcccagggcttctgatggtcagcatcttccccaacacttaggattgtgagactttttaatgtttgtcgatccaatgacttgtggttttgttgtggttgtaatatccatttccctgatgattgagaagttaaaccctcacatgttaattgaaccttagatatcttcataatgtgtatttgtttaccccttttccttcatttatttgaatgtattcttatattctcttggcaattaaagttctgcagacacctt

SEQ ID NO: 190317 - DNA, 2170 bp, Homo sapiens
  Payload ID: 17598
  Gene Name: tetra-peptide repeat homeobox-like
  ENST ID: ENST00000326972
  CDS Start-End: 223-642
aaaatgatggctatgtggacatgagcagcttcaacacctttaagaacaatcagcagagcacagaccaggacgcagaaagacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccagcagcagcagcagcagccccagtagcagctccagcagccccagtagcagctctagcagcagcagctccagcagcagcagtcccagcagcagcagccccagtagcagcggcagcagccccagtagcagcaacagcagccccagtagtagcagcagcagccccagtagcagcagcagcagccccagcccccgtagcagcagccccagcagcagcagctccagcaccagcagtcccagcagcagcagtcccagcagcagcagccccagcagcagctgccccagtgcagccctgggcaggaggccacagagcccacagagctcgcactgtgccccctttccctgaagctgcggcctctgccccccatcagcctggcctcttgggaattctcccacagggagaggccccgtgggtattctcccacaatctgcagcctccaccaggccttgagtagctttgggtgcagagccaggagggcgtttggctgtcctaggtctagcccctggcccaatcccagccccattccaggcccactcaaaagccaaggcccaatcccaggtccaggctcaatcctaggccctggcctgattccaagccaggcttactcccaggcccaggcttagtcctagccccaatcccaggtcctggcccaatcccaaacttaggatccctcccagccccagccctagtccccttgtgacctcagagcacttatgcctccaatttcttgccagacagtcattccctgacttcacagagctcctcccacccctagaccagttcgaggaatccttggtctccaccacgacatctcagtaccaagagggggatggctctatggacaaaaagactcgggccccaagtgattaatggatttatagggggcctgtgtctgcaaagtcctgcggataccagtggacctggagtggctggttggtctacactgctggtgaatgcaccaccaccatttaaccaccctgccgctggtgggcatttgctgtcttcactgtgtggccatcacgactagctctgctatgaatgcacctgccctcatttgagttgagcctgagcatttcgcagctgggattggagtcgctgctcatggggatgtttggcattagtggatgctacttgagagctttgtaaagagctttactcagcacttctgatagtcagcattctccctgacacttaggattgtgagactttttaatgtttgtggatccaatggcttatggcttccctgatgactgagaggttgagaagttctcacatgttaattgaaccttagaaatcctcatatgtgtccatttgtttgcccatttttcttcatttatttgaatgtatttttatattctcttgataattaaagtgctgcaaacaccccccaaaaat

SEQ ID NO: 190318 - DNA, 2356 bp, Homo sapiens
  Payload ID: 17598
  Gene Name: tetra-peptide repeat homeobox-like
  ENST ID: ENST00000424053
  CDS Start-End: 409-828
ctccctgcctgtcgagtctgcacacgggtttcacgccctcccctgtgttctggccaggagactttgcgttcggttggaattgttacagagttcagctggaggtttccttctccctgtggccttttcccagttcctctggcagccctcctcaaggacccctgtgagataagtcagaggtgactttcctggggacccagagaacccacaaggcttttcccactgcttactgtattttgctcggctctctaaattgaatcaattgcagacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccagcagcagcagcagcagccccagtagcagctccagcagccccagtagcagctctagcagcagcagctccagcagcagcagtcccagcagcagcagccccagtagcagcggcagcagccccagtagcagcaacagcagccccagtagtagcagcagcagccccagtagcagcagcagcagccccagcccccgtagcagcagccccagcagcagcagctccagcaccagcagtcccagcagcagcagtcccagcagcagcagccccagcagcagctgccccagtgcagccctgggcaggaggccacagagcccacagagctcgcactgtgccccctttccctgaagctgcggcctctgccccccatcagcctggcctcttgggaattctcccacagggagaggccccgtgggtattctcccacaatctgcagcctccaccaggccttgagtagctttgggtgcagagccaggagggcgtttggctgtcctaggtctagcccctggcccaatcccagccccattccaggcccactcaaaagccaaggcccaatcccaggtccaggctcaatcctaggccctggcctgattccaagccaggcttactcccaggcccaggcttagtcctagccccaatcccaggtcctggcccaatcccaaacttaggatccctcccagccccagccctagtccccttgtgacctcagagcacttatgcctccaatttcttgccagacagtcattccctgacttcacagagctcctcccacccctagaccagttcgaggaatccttggtctccaccacgacatctcagtaccaagagggggatggctctatggacaaaaagactcgggccccaagtgattaatggatttatagggggcctgtgtctgcaaagtcctgcggataccagtggacctggagtggctggttggtctacactgctggtgaatgcaccaccaccatttaaccaccctgccgctggtgggcatttgctgtcttcactgtgtggccatcacgactagctctgctatgaatgcacctgccctcatttgagttgagcctgagcatttcgcagctgggattggagtcgctgctcatggggatgtttggcattagtggatgctacttgagagctttgtaaagagctttactcagcacttctgatagtcagcattctccctgacacttaggattgtgagactttttaatgtttgtggatccaatggcttatggcttccctgatgactgagaggttgagaagttctcacatgttaattgaaccttagaaatcctcatatgtgtccatttgtttgcccatttttcttcatttatttgaatgtatttttatattctcttgataattaaagtgctgcaaacaccccccaaaaat

SEQ ID NO: 190319 - DNA, 2256 bp, Homo sapiens
  Payload ID: 17598
  Gene Name: tetra-peptide repeat homeobox-like
  ENST ID: ENST00000429201
  CDS Start-End: 309-728
ggacccctgtgagataagtcagaggtgactttcctggggacccagagaacccacaaggcttttcccactgcttactgtattttgctcggctctctaaattgaatcaattgcaggtaagtcagggatttcttcttggtttggatccactgctggtgagcagacagagtcttgccctgttgcccaggctggagtatagtagtgcagtggtgtgatcatagctcactgtaacttcgaccacctgggctcaaacaatccttcttcctctgcctcccaagtagctgggactacagaacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccagcagcagcagcagcagccccagtagcagctccagcagccccagtagcagctctagcagcagcagctccagcagcagcagtcccagcagcagcagccccagtagcagcggcagcagccccagtagcagcaacagcagccccagtagtagcagcagcagccccagtagcagcagcagcagccccagcccccgtagcagcagccccagcagcagcagctccagcaccagcagtcccagcagcagcagtcccagcagcagcagccccagcagcagctgccccagtgcagccctgggcaggaggccacagagcccacagagctcgcactgtgccccctttccctgaagctgcggcctctgccccccatcagcctggcctcttgggaattctcccacagggagaggccccgtgggtattctcccacaatctgcagcctccaccaggccttgagtagctttgggtgcagagccaggagggcgtttggctgtcctaggtctagcccctggcccaatcccagccccattccaggcccactcaaaagccaaggcccaatcccaggtccaggctcaatcctaggccctggcctgattccaagccaggcttactcccaggcccaggcttagtcctagccccaatcccaggtcctggcccaatcccaaacttaggatccctcccagccccagccctagtccccttgtgacctcagagcacttatgcctccaatttcttgccagacagtcattccctgacttcacagagctcctcccacccctagaccagttcgaggaatccttggtctccaccacgacatctcagtaccaagagggggatggctctatggacaaaaagactcgggccccaagtgattaatggatttatagggggcctgtgtctgcaaagtcctgcggataccagtggacctggagtggctggttggtctacactgctggtgaatgcaccaccaccatttaaccaccctgccgctggtgggcatttgctgtcttcactgtgtggccatcacgactagctctgctatgaatgcacctgccctcatttgagttgagcctgagcatttcgcagctgggattggagtcgctgctcatggggatgtttggcattagtggatgctacttgagagctttgtaaagagctttactcagcacttctgatagtcagcattctccctgacacttaggattgtgagactttttaatgtttgtggatccaatggcttatggcttccctgatgactgagaggttgagaagttctcacatgttaattgaaccttagaaatcctcatatgtgtccatttgtttgcccatttttcttcatttatttgaatgtatttttatattctcttgataattaaagtgctgcaaacaccccccaaaaat

SEQ ID NO: 190320 - DNA, 932 bp, Homo sapiens
  Payload ID: 17598
  Gene Name: tetra-peptide repeat homeobox-like
  ENST ID: ENST00000532924
  CDS Start-End: 345-764
tctggagatctgttttctggttttggctgtgccataaacgattatttatgaaaactgcaatagtcatcatttaaagttatggaactgtgtccggaattggtgggttcttggtctcactgacttcaagaatgaagccgcggacccttgcggtaagtcagggatttcttcttggtttggatccactgctggtgagcagacagagtcttgccctgttgcccaggctggagtatagtagtgcagtggtgtgatcatagctcactgtaacttcgaccacctgggctcaaacaatccttcttcctctgcctcccaagtagctgggactacagaacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccagcagcagcagcagcagccccagtagcagctc

SEQ ID NO: 190321 - DNA, 549 bp, Homo sapiens
  Payload ID: 17598
  Gene Name: tetra-peptide repeat homeobox-like
  ENST ID: ENST00000524375
  CDS Start-End: 259-549
aaactaaaatgatggctatgtggacatgagcagcttcaacacctttaagaacaatcagcagagcacagaccaggacgcagaaagattatttatgaaaactgcaatagtcatcatttaaagttatggaactgtgtccggaattggtgggttcttggtctcactgacttcaagaatgaagccgcggacccttgcggtaagtcagggatttcttcttggtttggatccactgctggtgagcagaacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcct

SEQ ID NO: 190322 - DNA, 597 bp, Homo sapiens
  Payload ID: 17598
  Gene Name: tetra-peptide repeat homeobox-like
  ENST ID: ENST00000528312
  CDS Start-End: 330-597
agagtctcgctctgtcgcccaggctggcagcctccctagtagctgggactacaggcacctgccaccacgcctagctaattttttgtatttttttagtagagacggggtttcactgtgttagccaggtctccatctcctgacctcgtgatctgcctgcctcggcatcccaaagtgctgggattacagacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccaga

SEQ ID NO: 190323 - DNA, 563 bp, Homo sapiens
  Payload ID: 17598
  Gene Name: tetra-peptide repeat homeobox-like
  ENST ID: ENST00000528067
  CDS Start-End: 200-563
ttgttacagagttcagctggaggtttccttctccctgtggccttttcccagttcctctggcagccctcctcaaggacccctgtgagataagtcagaggtgactttcctggggacccagagaacccacaaggcttttcccactgcttactgtattttgctcggctctctaaattgaatcaattgcagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagc

SEQ ID NO: 190324 - DNA, 508 bp, Homo sapiens
  Payload ID: 17598
  Gene Name: tetra-peptide repeat homeobox-like
  ENST ID: ENST00000528040
  CDS Start-End: 308-508
ttgcataaatgtttcaagtatctaacagacagcttacagtagatgtacacaatggtttgcaataagatctactctccttcctctggttcaaggaaaaaaattatctggatttttgccacttcaagaccaagactgctgccatgctagaaaagggctggggtaagacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtgg

SEQ ID NO: 190325 - DNA, 533 bp, Homo sapiens
  Payload ID: 17598
  Gene Name: tetra-peptide repeat homeobox-like
  ENST ID: ENST00000530586
  CDS Start-End: 359-533
agagccctgtccacagcaaactaaaatgatggctatgtggacatgagcagcttcaacacctttaagaacaatcagcagagcacagaccaggacgcagaaagattatttatgaaaactgcaatagtcatcatttaaagttatggaactgtgtccggaattggtgggttcttggtctcactgacttcaagaatgaagccgcggacccttgcgacagagtcttgccctgttgcccaggctggagtatagtagtgcagtggtgtgatcatagctcactgtaacttcgaccacctgggctcaaacaatccttcttcctctgcctcccaagtagctgggactacagaacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatc

SEQ ID NO: 190326 - DNA, 539 bp, Homo sapiens
  Payload ID: 17598
  Gene Name: tetra-peptide repeat homeobox-like
  ENST ID: ENST00000529129
  CDS Start-End: 286-539
gattttttgtataaggtgagagatgaggatccagttttggtctcctacacgtggctagccaattatcccagcaccatttgtggaaaaggatgccctttccccactttatgattttgtttgctttgttgaagatcagttggctacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagct

SEQ ID NO: 190327 - DNA, 771 bp, Homo sapiens
  Payload ID: 17598
  Gene Name: tetra-peptide repeat homeobox-like
  ENST ID: ENST00000532880
  CDS Start-End: 572-771
cagcgctgaccattcagactatgagaacattccaaccatgaactcagactatgagaatatccagattctgccctggaggcctgcagggctggtgtgttcaggaagctgtttgaagatcagagcagagccctgtccacagcaaactaaaatgatggctatgtggacatgagcagcttcaacacctttaagaacaatcagcagagcacagaccaggacgcagaaaggagtggacaacacctggccccagctgagtgcctcctagcactgaggaaagcagaaccaagctttgcaacaatgaactctccttgctggaagagaccgcccacctctaacagaattttgtagctggaggaaacttcagacacaagtcctgttacagaagaggaaactggcacagagaggaaatggtgcttgcataaggtctctggacagagtcttgccctgttgcccaggctggagtatagtagtgcagtggtgtgatcatagctcactgtaacttcgaccacctgggctcaaacaatccttcttcctctgcctcccaagtagctgggactacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtg

SEQ ID NO: 190328 - DNA, 1615 bp, Homo sapiens
  Payload ID: 17599
  Gene Name: tetraspanin 1
  Uniprot ID: O60635
  ENST ID: ENST00000372003
  CDS Start-End: 465-1190
agacacacacaccagcagctacacctacacgctgaccatcacaggcacacagaggcacatccacctcacatccacctcatacttgtgtactctcagggttcagtctttcatcctatccctctctgatctgtgcctcccaataccttccaagatgtttacagagacccttctccctgtgcagttaggagtgtaaggcaagagagcccctacttcatggggcagatcaagagctgagaccaaagatggtctatgttgctgaccttgtcctgtcctcctgctgtcttaaactatgatccctgctgcggtcactgaagcctttccctgtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgtt

SEQ ID NO: 190329 - DNA, 1837 bp, Homo sapiens
  Payload ID: 17600
  Gene Name: tetraspanin 10
  ENST ID: ENST00000574882
  CDS Start-End: 202-1383
ccccgccatccctgcaactggaggaggggattttggaaagttgcgtctgagattacttctgctcgtcctcggaaacccaagcggcacaggaaagtccaaaaaggaagcaaagacgagcatccgaagtctcacccaaaaataactactgctgcgtattatagcgtattataattggggaaacagcattccaaacttctctccatgcacagactagcccagggccgcagtcaggaccagcccagcagcccagccacagaggagccagcgaacctctcccggcgcctgtgctgggggctttctgttccagcgtcaaggatggaggagggggagaggagccccttactgtcccaggaaactgcaggccagaagcccctctctgtgcacaggccacccacctcaggctgcctaggtccagtgcccagggaggaccaggcggaggcctggggctgcagctgctgtcccccggagaccaagcaccaggccttgagtggcacccccaagaaaggaccagccccttccctctccccagggagcagctgcgtcaagtatctgatcttcctctccaacttccccttctccctgctggggctgctggccctggccatcgggctctggggcctggctgtcaaggggtctctgggaagtgatctgggggggcccctgcccgcagaccccatgctggggctggcactgggagggctggtggtcagcgcagtgagcctggctggctacctgggcgccctctgtgagaacacctgcctgttacgtggcttctctgggggcatccttgccttcctggtgcttgaggccgtggcgggggccctggtggtggccctctggggcccgctgcaagacagcctggagcacaccctgcgtgtggccatcgcccactaccaggacgacccagacctgcgcttcctcctcgaccaagtccagctcgggctgaggtgctgcggagctgcctcctaccaggactggcagcagaacctgtactttaactgcagctcccccggggtgcaggcctgcagccttcccgcctcctgctgcatcgacccccgcgaagatggagcctctgtcaacgaccagtgcggcttcggggtcctgcgcctggatgcggacgcagctcagagagtggtgtacctggagggctgcggcccgccgctccggcggtggctgcgcgcgaacctggctgcctcgggcggctacgcaatcgcggtggtgctgctgcagggcgcggagctcctgctggccgcccggctactcggggccctcgctgcccgcaggggggcggcgtacggccccggagcgcgcggggaggaccgcgctggcccccagagccccagccccggcgccccgcccgctgccaagcccgcccggggctgagcgcacgccccgaggtccgagaccgccacgcacagggatacagggggcgcctccgcccggctaaaaagcgcggcctgcgccgccgccgccgcctgatttcgctcgggcttcgggtgacttcgccgcaggacctacccagctcgctcacttcgctcgctccgcgtcccccatgccagcccccaacgcagggcgcccggcgaagccacgggactggcgggaggagcacgcggggccggaggaaatcctgaagctgaccctcacctccgagcccccactcccaccccagccgcacagttcccacctcctggcacctccctcccctggggccgccaccccttctgggctcgtgatggtggagctaaggtccaggcctctccctcccgagtgcatttttggggagatagtaaatgttttattcgggtgtatcattcatacagtaaagacaccaatcttc

SEQ ID NO: 190330 - DNA, 1868 bp, Homo sapiens
  Payload ID: 17600
  Gene Name: tetraspanin 10
  ENST ID: ENST00000621293
  CDS Start-End: 78-785
ccagcagcccagccacagaggagccagcgaacctctcccggcgcctgtgctgggggctttctgttccagcgtcaaggatggaggagggggagaggagccccttactgtcccaggaaactgcaggccagaagcccctctctgtgcacaggccacccacctcaggctgcctaggtccagtgcccagggaggaccaggcggaggcctggggctgcagctgctgtcccccggagaccaagcaccaggccttgagtggcacccccaagaaaggaccagccccttccctctccccagggagcagctgcgtcaagtatctgatcttcctctccaacttccccttctccctgctggggctgctggccctggccatcgggctctggggcctggctgtcaaggggtctctgggaagtgatctgggggggcccctgcccgcagaccccatgctggggctggcactgggagggctggtggtcagcgcagtgagcctggctggctacctgggcgccctctgtgagaacacctgcctgttacgtggcttctctgggggcatccttgccttcctggtgcttgaggccgtggcgggggccctggtggtggccctctggggcccgctgcaagacagcctggagcacaccctgcgtgtggccatcgcccactaccaggacgacccagacctgcgcttcctcctcgaccaagtccagctcgggctgaggtgctgcggagctgcctcctaccaggactggcagcagaacctgtactgcctctcaagcccttgctcttcccagtaagacctgtggaccattccagaagcctctgccagagttccatccaccctcccctgctccaactctaccttctcaatgagctcagcagcctctgcggagggaggtcctcttatcaatgcttgtctgttcccccttcaaccgtctcactaaatatcctcctgctagtcaacacagccaccacccctacctgcaagcgcagaggactgccgtgcacagggatacgttatagagagccaggtactttaactgcagctcccccggggtgcaggcctgcagccttcccgcctcctgctgcatcgacccccgcgaagatggagcctctgtcaacgaccagtgcggcttcggggtcctgcgcctggatgcggacgcagctcagagagtggtgtacctggagggctgcggcccgccgctccggcggtggctgcgcgcgaacctggctgcctcgggcggctacgcaatcgcggtggtgctgctgcagggcgcggagctcctgctggccgcccggctactcggggccctcgctgcccgcaggggggcggcgtacggccccggagcgcgcggggaggaccgcgctggcccccagagccccagccccggcgccccgcccgctgccaagcccgcccggggctgagcgcacgccccgaggtccgagaccgccacgcacagggatacagggggcgcctccgcccggctaaaaagcgcggcctgcgccgccgccgccgcctgatttcgctcgggcttcgggtgacttcgccgcaggacctacccagctcgctcacttcgctcgctccgcgtcccccatgccagcccccaacgcagggcgcccggcgaagccacgggactggcgggaggagcacgcggggccggaggaaatcctgaagctgaccctcacctccgagcccccactcccaccccagccgcacagttcccacctcctggcacctccctcccctggggccgccaccccttctgggctcgtgatggtggagctaaggtccaggcctctccctcccgagtgcatttttggggagatagtaaatgttttattcgggtgtatcattcatacagtaaagacaccaatcttca

SEQ ID NO: 190331 - DNA, 1068 bp, Homo sapiens
  Payload ID: 17600
  Gene Name: tetraspanin 10
  ENST ID: ENST00000611590
  CDS Start-End: 1-1068
atggaggagggggagaggagccccttactgtcccaggaaactgcaggccagaagcccctctctgtgcacaggccacccacctcaggctgcctaggtccagtgcccagggaggaccaggcggaggcctggggctgcagctgctgtcccccggagaccaagcaccaggccttgagtggcacccccaagaaaggaccagccccttccctctccccagggagcagctgcgtcaagtatctgatcttcctctccaacttccccttctccctgctggggctgctggccctggccatcgggctctggggcctggctgtcaaggggtctctgggaagtgatctgggggggcccctgcccgcagaccccatgctggggctggcactgggagggctggtggtcagcgcagtgagcctggctggctacctgggcgccctctgtgagaacacctgcctgttacgtggcttctctgggggcatccttgccttcctggtgcttgaggccgtggcgggggccctggtggtggccctctggggcccgctgcaagacagcctggagcacaccctgcgtgtggccatcgcccactaccaggacgacccagacctgcgcttcctcctcgaccaagtccagctcgggctgaggtgctgcggagctgcctcctaccaggactggcagcagaacctgtactttaactgcagctcccccggggtgcaggcctgcagccttcccgcctcctgctgcatcgacccccgcgaagatggagcctctgtcaacgaccagtgcggcttcggggtcctgcgcctggatgcggacgcagctcagagagtggtgtacctggagggctgcggcccgccgctccggcggtggctgcgcgcgaacctggctgcctcgggcggctacgcaatcgcggtggtgctgctgcagggcgcggagctcctgctggccgcccggctactcggggccctcgctgcccgcaggggggcggcgtacggccccggagcgcgcggggaggaccgcgctggcccccagagccccagccccggcgccccgcccgctgccaagcccgcccggggctga

SEQ ID NO: 190332 - DNA, 5505 bp, Homo sapiens
  Payload ID: 17601
  Gene Name: tetraspanin 11
  Uniprot ID: A1L157
  ENST ID: ENST00000261177
  CDS Start-End: 60-821
agtggaggaggcaggaatgcctgggacactcgcggggcatgtgagcaggcccagaagccatggcccactataagactgagcaggacgactggctgatcatctacttgaagtatttactctttgtcttcaacttcttcttctgggtcgggggagcagccgtcctggctgtgggcatctggaccctggtggagaagagtggctacctcagcgtcctggcctccagcacctttgccgcctccgcctacatcctcatctttgcgggcgtacttgtcatggtgaccggcttcctgggcttcggtgccatcctctgggagcggaagggctgcctctccacgtatttctgcctgttgctcgtcatcttcctggttgagctggtggcgggagtcctggcccatgtgtattaccagaggctgagtgatgaactgaagcagcacttgaaccggactctggctgagaactacgggcagcccggagccacgcagatcaccgcctcagtggaccgactccagcaggatttcaagtgctgtggaagcaacagctcagccgactggcagcacagcacgtacatcctgttgcgggaggccgagggccgccaggtgcccgacagctgctgcaagacagtggtggtgcgctgcggccagcgggcccacccctccaacatctataaggtggagggaggctgcctcaccaagctggagcagttcctggccgaccacctgctgcttatgggggcagtgggcatcggggtggcctgcctgcagatctgcgggatggttctcacctgctgcttgcaccagaggctccagcggcatttttactaatggccaaccacctcctcttccaactgcccctcaagacaacatgtggccacatgccatctgcaaggcctgcagagttagcaccagctccactagggccatagatgccccctcctttgtgcctagctcctgcgaatccaccgagtgcctgagaccatagcttctgtgcccacccaggcagagaccctcggccccctctcctccatttctgagcccccatggccagatcctgggcagggaaatgatcctttcaggagacaaccagagcccctcaccaggaacgggggcacccgtggactacgggagggtggcggttgggttctctgctccctcccagctcctgaacctggaacaatcggcagaaaacccaggaaccccggcactcctgcattcagcacgggattcccccacccatgcccagaagccctgaccttgctgtttctggaaaaagcatggggtggggcagggagggctggcatttcccccagaagaccttgccctttgacctgcccactctccacactgcctcacctggaaagccatgtcctgctggcctcattccttcctgaagggcctaggagtggggaggcctgggtagggcagccacaggctgggtagagccgccctggcaggaagcagggggtaaggtggccataccagcacatgctgcactaggagcagagccctgcacctgcctagctgccttcctgggagaaacctccctgggagaccatggccccaagccctggcctctagtgatacgcccctcgggaatctcctgttccggggcctgattctcaggaacaccaggtttcagaccatcttcagcacctaatgttgatgggtgtcaaacatctcctggagtggaccaactcgcaaccctgcaaagtcggagctgctgagaaggggcagctctgaatagaggggcatctgcctgaacctcacttttcctggggccctctccttgaccccgtagccaccaccacactgcttccagggggtccagctctgcttcccttcccacctgtcctagagtggacagagctttttccttgggttctctcttgcatcactaagttcagcagggaatttgcggaattttcaggaagaactttccccagtaataagggagaacagaaagaaaatcctagaaaatacagagtatccatgctggcagctttttgtacaacacccatagggacccccccaaatggctattacaaaggggcagcccattcactacacaagaaccccacacctggcttccaccctccccagctcctgcacttctccccagagcgggaccctcttacttccccccatgaaggggggcaccttgtgctaaggccaaggctgagcgaggtcccagctcacctccctgcttgatccagattgcactgtgatgagcacattgctgacctaggccagtcctggggcaggcgtgctctctctcccatacataggagtggcctcaaggccacccagtgctgaccccaacagagccctgaactgtccagaaactgcatcctcagcacaggaagtacccacatggacagagggaagcccagcctcggggccggttgcctcctcttctctgggtgttctccagtggcttcttggagcctaggctggtttatctcccctgcctaaaaggccctggggttgccaatgcaaattcattaaaacgaagaccagatatcccagactgcacagaggccgagagaaatggtatagtgcgtgattagcattgctgccctccaacctcctgggattcatgcagataatcaaaaactgactatgactcccaagttctctgaaggatgagatcacaactgacaactcttacgacagagggagagtggtgagagagagaaagagggtactgggctagagccatgttcttcctgccgaggtgccagggggaggcggcagtgggcagggggtgctggggccttacctgtctgccctggtggggatgaaagacaggtgacaggcaggtgccctgtgcacagccttatcattgaaggcaggcccaggacagcctgccccatctgccccagccccatgggatggttggtccagcctgactggggcaggattagctgcaattcctgccctgtgtgtcgtccagccagactgcctcttgaaagatggcttgtccaagcggcagacagtggtagaacaacccagggcttggaaatctgacctccttgtccatgccaacagcctgggagatgagacagggttagaggaaacagaggcccaggatacggcaggttctgcctgggagtgtacaatggttggagtccagagccaacgatgtggtccccagcggggtgtgcccctcctgctgacgagggtacagatccatacccaggtcaattcctcccgggcccctgtttggaggctgctacagccttgagttccttggagagagaggacacgcctgtggaatgtcaccttcagtcccgtgcaggcaaaaggcccctgcacaccagggccctaggaaagcagcatcaggtgctgggatcccacccagctggcacgggcacgttcttgccctgcacactccatgctgcccttccctgagctcgcaggggcagacaccaagagaagggcgcgtccccgagtcccctgggtgacctgtgtcaggacagcaggcaagaatgaaacgtggccttggctgacgggttggaatatttgtgaccgttcttgtctttctccctcctgcttccccggcaccctagccccatctccaggagcccctcaggcagagtaagtggggagtgtgtccagggatttttttgtgtttaccaaggtcctgctgtgcacttagaatctgtcaccataaatacttatctcgcagttaccccagcaagagggtgttatttcccccattttataaaaggaaattaaggctgggcaaagttaagacttgcttgtcagtggtcatggctgttgtcttgccacccccagctggggagaaggaagaaaactgggccgggaacccctcccctcagtgtcccccagttctccatctccataaggagccatcaggctgtcattaaggaacagagtgtcactcagggggcactgtcacaaagcagcacccatggcacatgggccgggggtgcagaagcctggcttatttcaggctgacagctggaccctctgggtgcaggggctcaggcagtggccaagagcccaaagggctaaggcccgtgacgaccacccagcccgtcaccccaggtacaaacactgaccccaaagcaagagcagggactgtccctcagccctcagggccttcatgcagggtgcagaatctcatgtccacatggaggtcacccctcaggtcacacccactcccagagcaaccctgggcagggaggggcaccctggggttgtgttgaccacctccccttcaggtgaggcccttttctgccttctttctagccccctgcatggggcacctgctattgctggggctctggggtggaccctgtgtgatttctgtcagggagcttgtgctgtgcatggccagaggtgtttacatccagaagggcccagcacggccctgtggggtgtggggggaatatggtagatcattgtgatgtgcctcggggccctcttgccttggagccagctttgtttcagaatctgctacttgggccctcttcagggttttgaggctggagaagtgagttgggacagtcactgtcatcaccacccaccctgtcacccacctggaaaacattcttgatatactggccatgctgggccgggctcacatccactgagggtatagtgaccaagcgtctaaaccagtcgttctcaaacttcggtgagtatcagaatcacctggaagggcttttacaaacagattgctggccccaccccccagaatttctcatcaggagtgggcaagaccaatcatttgcatttctgacaagttcccaggagctgcagctgctggccctggaaccacactttgagaaccactgctttagaccaaacaccaaaggaagatgcagccaccctcctttacatgtcacaacgctcagggtccatgagtacctcaggctgtccagctgagctccacctgcagcagccgagattcccgactcgctccaccattgggggctaggagtgaagcgtgtcaccatggtcagctcatggccagccaggaaagcctctctgctgtgcgtctgtgcagttcttgttcttccctggaggactcttggatcgcctgtgatcttggccaggagaccaggtgcctgggtcccttcctggaaggggacaagttacacaccccagccccattttcccaccaacttctacatgccttgggagaacctgctacatgttggctgcccccttcccctatttcagcagtgcccagtcctgcttataaacctgaggcctgctccccataccctgccctgtgcaagtgccagccgttattccaggcagcccaatgttgttgaggccagatggattcctggaagcagctggcccatggatgtgagtcatcacagtattctagaaacagagaagaggtcttaacctaatgcgcatagagaaattgttctcattgtaaacatacccctgtccttagctgatctaggtggaagcccagcttcatgtgctagggggcatgataatgataataaaggaattgtatctagga

SEQ ID NO: 190333 - DNA, 1058 bp, Homo sapiens
  Payload ID: 17601
  Gene Name: tetraspanin 11
  Uniprot ID: A1L157
  ENST ID: ENST00000546076
  CDS Start-End: 61-822
agtctctctaggcgcagctcccttcgccgcttccggagcccctggcagggcccagaagccatggcccactataagactgagcaggacgactggctgatcatctacttgaagtatttactctttgtcttcaacttcttcttctgggtcgggggagcagccgtcctggctgtgggcatctggaccctggtggagaagagtggctacctcagcgtcctggcctccagcacctttgccgcctccgcctacatcctcatctttgcgggcgtacttgtcatggtgaccggcttcctgggcttcggtgccatcctctgggagcggaagggctgcctctccacgtatttctgcctgttgctcgtcatcttcctggttgagctggtggcgggagtcctggcccatgtgtattaccagaggctgagtgatgaactgaagcagcacttgaaccggactctggctgagaactacgggcagcccggagccacgcagatcaccgcctcagtggaccgactccagcaggatttcaagtgctgtggaagcaacagctcagccgactggcagcacagcacgtacatcctgttgcgggaggccgagggccgccaggtgcccgacagctgctgcaagacagtggtggtgcgctgcggccagcgggcccacccctccaacatctataaggtggagggaggctgcctcaccaagctggagcagttcctggccgaccacctgctgcttatgggggcagtgggcatcggggtggcctgcctgcagatctgcgggatggttctcacctgctgcttgcaccagaggctccagcggcatttttactaatggccaaccacctcctcttccaactgcccctcaagacaacatgtggccacatgccatctgcaaggcctgcagagttagcaccagctccactagggccatagatgccccctcctttgtgcctagctcctgcgaatccaccgagtgcctgagaccatagcttctgtgcccacccaggcagagaccctcggccccctctcctccatttctgagcccccatggccagatcctgggcaggg

SEQ ID NO: 190334 - DNA, 1649 bp, Homo sapiens
  Payload ID: 17601
  Gene Name: tetraspanin 11
  ENST ID: ENST00000545802
  CDS Start-End: 381-506
cggcaaccgcacagctgcctcggactctgacttaattccctccgcgtgctctgaatcgcagagaggcaaacccccaaacaaagagccggcagctcgcgtgcggggctcccgggcgcgtcctgccggctgggctgggagagccggcgccggggcgtcgcggccgagcgctgggcaggcggggactagagggccggcaggaagcctcagtgggcgcaggggcgcgggccgggctgcccacacgctgaccttcccgggctgggagggaggagcgctggctgcgggcggtgggcggctgggcggccccgggagccgccgctctcagtctctctaggcgcagctcccttcgccgcttccggagcccctggcagggcccagaagccatggcccactataagactgagcaggacgactggctgatcatctacttgaagtatttactctttgtcttcaacttcttcttctgggtgagtgaattctgcacacacatcctcttccccgagcactgaatgagtcaagccaccttttgtttttttgtgtcaccactttgaggttgatatcttccaaatcaaagatcaacgatcaaccatgggtgaattcttcccactttaaagcaaatatgtacatttgctactgagaaagaagaaaagaattgggtctgcaggttggcatggagtttgtaccacatggcatctgaatagaggcacaaacataacaataggctttgtgttctagccctgctgtacaaagggtccggttctttcttccccactaacttgttgcaccagcgccttttggaaaatgtgactgcctgaaataataacttgttttccactgaaatccattcacctttcatggttaacattctccaggcccagggcagagaaacagaagtcctggaggctccaactactgctgcctgtgatgaaaataatctctatggcaactctcctcaggagcctgcctgggtgaggtcttccagaggagtgtagtctgtccacttgaagcaatcatctgggtaattgggagcagaataccatcagttcccaaaaatagacactggaatatatatatttgttattacagtctcactaaatttgagaaggtagaagagtgacaagagtgcaggctttgcaggcagctgtacccatgctctgctgactactaatggtggagccttgggcaacttacctaacttcaaggaatctgcttccccagctgcaattcaatgataatttctagcctgttggggttgcattcagtaaatgcagtattttgaatatattagatgtcaaatgcctgaaaataccaccaaatcaacccatgataaggcatagctgggcttcctgctaccatggtgagggagaagacacttgacagagtcttagaagcatctcagaaaggcaaatgcagaagtgggggacatgtctgagttttcagggtctttcttgcaggggcttgcttaagattgggaaagaccatgatgtgagagtttaggatgggtagacatggcaaggcaagagttttgaagagtcttggagaataaaccagtcattagatgctatctgttaaaaagttgtgcgatctgctatttgtttaaatgttgtttgcaaagttcctgaaaggaataataaaataatttgtcactttta

SEQ ID NO: 190335 - DNA, 988 bp, Homo sapiens
  Payload ID: 17601
  Gene Name: tetraspanin 11
  ENST ID: ENST00000535215
  CDS Start-End: 232-780
agactgtcccgagcttcccccgggcgggcagagggaagccggctggggatgaggagtggaggaggcaggaatgcctgggacactcgcggggcatgtgagcaggtcgggggagcagccgtcctggctgtgggcatctggaccctggtggagaagagtggctacctcagcgtcctggcctccagcacctttgccgcctccgcctacatcctcatctttgcgggcgtacttgtcatggtgaccggcttcctgggcttcggtgccatcctctgggagcggaagggctgcctctccacgtatttctgcctgttgctcgtcatcttcctggttgagctggtggcgggagtcctggcccatgtgtattaccagaggctgagtgatgaactgaagcagcacttgaaccggactctggctgagaactacgggcagcccggagccacgcagatcaccgcctcagtggaccgactccagcaggatttcaagtgctgtggaagcaacagctcagccgactggcagcacagcacgtacatcctgttgcgggaggccgagggccgccaggtgcccgacagctgctgcaagacagtggtggtgcgctgcggccagcgggcccacccctccaacatctataaggtggagggaggctgcctcaccaagctggagcagttcctggccgaccacctgctgcttatgggggcagtgggcatcggggtggcctgcctgcagatctgcgggatggttctcacctgctgcttgcaccagaggctccagcggcatttttactaatggccaaccacctcctcttccaactgcccctcaagacaacatgtggccacatgccatctgcaaggcctgcagagttagcaccagctccactagggccatagatgccccctcctttgtgcctagctcctgcgaatccaccgagtgcctgagaccatagcttctgtgcccacccaggcagagaccctcggccccctctcctccatttctg

SEQ ID NO: 190336 - DNA, 2798 bp, Homo sapiens
  Payload ID: 17602
  Gene Name: tetraspanin 12
  Uniprot ID: O95859
  ENST ID: ENST00000222747
  CDS Start-End: 609-1526
aagcctgcttctctatgcttataacccagcctccattccttcgacgccaccattttaaagggatttactgcacggacttctcccaagttcctaggcattatcttctggaccctatcctgcagaggtgaagcgtccctttggggactctcgctgggtgagagggacaagaaacacccactaggacccaaccccggcagccagcggctcgagcatgcgctgagagtttgtgcagctggccctggctgccgccgctgcctcgtccggactcggagaggacttgggagggacagcggcgctgggaggtggcttagcagagactttccagcaactgctgcccaggacttttttttttttttttctttttcccaggaggcggcgacggcggcggcggggggagaggaagagaaagaagcgtctccagctgaagccaatgcagccctccggctctccgcgaagaagttccctgccccgatgagcccccgccgtgcgtccccgactatccccaggcgggcgtggggcaccgggcccagcgccgacgatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttggacatatgaacaggaacttatggttccagtacaatggtcagatatggtcactttgaaagccaggatgacaaattatggattacctagatatcggtggcttactcatgcttggaatttttttcagagagagtttaagtgctgtggagtagtatatttcactgactggttggaaatgacagagatggactggcccccagattcctgctgtgttagagaattcccaggatgttccaaacaggcccaccaggaagatctcagtgacctttatcaagagggttgtgggaagaaaatgtattcctttttgagaggaaccaaacaactgcaggtgctgaggtttctgggaatctccattggggtgacacaaatcctggccatgattctcaccattactctgctctgggctctgtattatgatagaagggagccggggacagaccaaatgatgtccttgaagaatgacaactctcagcacctgtcatgtccctcagtagaactgttgaaaccaagcctgtcaagaatctttgaacacacatccatggcaaacagctttaatacacactttgagatggaggagttataaaaagaaatgtcacagaagaaaaccacaaacttgttttactggacttgtgaatttttgagtacatactatgtgtttcagaaatatgtagaaataaaaatgttgccataaaataacacctaagcatatactattctatgctttaaaatgaggatggaaaagtttcatgtcataagtcaccacctggacaataattgatgcccttaaaatgctgaagacagatgtcatacccactgtgtagcctgtgtatgacttttactgaacacagttatgttttgaggcagcatggtttgattagcatttccgcatccatgcaaacgagtcacatatggtgggactggagccatagtaaaggttgatttacttctaccaactagtatataaagtactaattaaatgctaacataggaagttagaaaatactaataacttttattactcagcgatctattcttctgatgctaaataaattatatatcagaaaactttcaatattggtgactacctaaatgtgatttttgctggttactaaaatattcttaccacttaaaagagcaagctaacacattgtcttaagctgatcagggattttttgtatataagtctgtgttaaatctgtataattcagtcgatttcagttctgataatgttaagaataaccattatgaaaaggaaaatttgtcctgtatagcatcattatttttagcctttcctgttaataaagctttactattctgtcctgggcttatattacacatataactgttatttaaatacttaaccactaattttgaaaattaccagtgtgatacataggaatcattattcagaatgtagtctggtctttaggaagtattaataagaaaatttgcacataacttagttgattcagaaaggacttgtatgctgtttttctcccaaatgaagactctttttgacactaaacactttttaaaaagcttatctttgccttctccaaacaagaagcaatagtctccaagtcaatataaattctacagaaaatagtgttctttttctccagaaaaatgcttgtgagaatcattaaaacatgtgacaatttagagattctttgttttatttcactgattaatatactgtggcaaattacacagattattaaatttttttacaagagtatagtatatttatttgaaatgggaaaagtgcattttactgtattttgtgtattttgtttatttctcagaatatggaaagaaaattaaaatgtgtcaataaatattttctagagagtaa

SEQ ID NO: 190337 - DNA, 693 bp, Homo sapiens
  Payload ID: 17602
  Gene Name: tetraspanin 12
  ENST ID: ENST00000430985
  CDS Start-End: 409-693
accccttcaccccccttctcaaacacaaatattatcatataataaaagcctgcttctctatgcttataacccagcctccattccttcgacgccaccattttaaagggatttactgcacggacttctcccaagttcctaggcattatcttctggaccctatcctgcagaggaggcggcgacggcggcggcggggggagaggaagagaaagaagcgtctccagctgaagccaatgcagccctccggctctccgcgaagaagttccctgccccgatgagcccccgccgtgcgtccccgactatccccaggcgggcgtggggcaccgggcccagcgccgacgatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatgg

SEQ ID NO: 190338 - DNA, 1167 bp, Homo sapiens
  Payload ID: 17602
  Gene Name: tetraspanin 12
  ENST ID: ENST00000450414
  CDS Start-End: 1-129
aatctgttgcttcttgcatggtactttggaagtttgcttgtcattttctgtgtagaactggcttgtggcgtttggacatatgaacaggaacttatgagcgaagagagtcatttggcaattgaacagtaaaatagaagtcatttctggtgctgatgtagtcttcaaagattctttggtgaatctactattgtgcttcgagactgttttgaatactaagtagtaaccacagactagtggctactctgcacactccaatttacatgtcagtggtgctttggcacactcacacatatgtatctctgtgaagacactcatgcttccaatgtacaacggcactaagttccagtacaatggtcagatatggtcactttgaaagccaggatgacaaattatggattacctagatatcggtggcttactcatgcttggaatttttttcagagagagtttaagtgctgtggagtagtatatttcactgactggttggaaatgacagagatggactggcccccagattcctgctgtgttagagaattcccaggatgttccaaacaggcccaccaggaagatctcagtgacctttatcaagagggttgtgggaagaaaatgtattcctttttgagaggaaccaaacaactgcaggtgctgaggtttctgggaatctccattggggtgacacaaatcctggccatgattctcaccattactctgctctgggctctgtattatgatagaagggagccggggacagaccaaatgatgtccttgaagaatgacaactctcagcacctgtcatgtccctcagtagaactgttgaaaccaagcctgtcaagaatctttgaacacacatccatggcaaacagctttaatacacactttgagatggaggagttataaaaagaaatgtcacagaagaaaaccacaaacttgttttactggacttgtgaatttttgagtacatactatgtgtttcagaaatatgtagaaataaaaatgttgccataaaataacacctaagcatatactattctatgctttaaaatgaggatggaaaagtttcatgtcataagtcaccacctggacaataattgatgcccttaaaatgctgaagacagatgtcatacccactgtgtagcctgtgtatgacttttactgaacacagttatg

SEQ ID NO: 190339 - DNA, 1495 bp, Homo sapiens
  Payload ID: 17602
  Gene Name: tetraspanin 12
  Uniprot ID: O95859
  ENST ID: ENST00000415871
  CDS Start-End: 360-1277
attccttcgacgccaccattttaaagggatttactgcacggacttctcccaagttcctaggcattatcttctggaccctatcctgcagaggtgaagcgtccctttggggactctcgctgggaggcggcgacggcggcggcggggggagaggaagagaaagaagcgtctccagctgaagccaatgcagccctccggctctccgcgaagaagttccctgccccgatgagcccccgccgtgcgtccccgactatccccaggcgggcgtggggcaccgggcccagcgccgacgatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttggacatatgaacaggaacttatggttccagtacaatggtcagatatggtcactttgaaagccaggatgacaaattatggattacctagatatcggtggcttactcatgcttggaatttttttcagagagagtttaagtgctgtggagtagtatatttcactgactggttggaaatgacagagatggactggcccccagattcctgctgtgttagagaattcccaggatgttccaaacaggcccaccaggaagatctcagtgacctttatcaagagggttgtgggaagaaaatgtattcctttttgagaggaaccaaacaactgcaggtgctgaggtttctgggaatctccattggggtgacacaaatcctggccatgattctcaccattactctgctctgggctctgtattatgatagaagggagccggggacagaccaaatgatgtccttgaagaatgacaactctcagcacctgtcatgtccctcagtagaactgttgaaaccaagcctgtcaagaatctttgaacacacatccatggcaaacagctttaatacacactttgagatggaggagttataaaaagaaatgtcacagaagaaaaccacaaacttgttttactggacttgtgaatttttgagtacatactatgtgtttcagaaatatgtagaaataaaaatgttgccataaaataacacctaagcatatactattctatgctttaaaatgaggatggaaaagtttcatgtcataagtcaccacctggacaataattgatgcccttaaaatgctgaagacag

SEQ ID NO: 190340 - DNA, 551 bp, Homo sapiens
  Payload ID: 17602
  Gene Name: tetraspanin 12
  ENST ID: ENST00000433758
  CDS Start-End: 192-551
attcacacccgagctgcgggacggggtagaggggtgcggagttggagtgcccaggaactgtcctaactagaagggcgctcattctctcgggcttgccggtggcgcctctgacgtgtccgggatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttggacatatgaacaggaacttatg

SEQ ID NO: 190341 - DNA, 569 bp, Homo sapiens
  Payload ID: 17602
  Gene Name: tetraspanin 12
  ENST ID: ENST00000424710
  CDS Start-End: 232-569
agtgccgagcacagctgtcctcgaggaggggcgtggagtgagggaggttttcaagagcgtctcatcagaatgcacagggctccgccgcgtgtcccctgagaacgcgagtttactgtgcgacttcattcatccggatagttgctcttttcttttcccagcagatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttg

SEQ ID NO: 190342 - DNA, 551 bp, Homo sapiens
  Payload ID: 17602
  Gene Name: tetraspanin 12
  ENST ID: ENST00000441017
  CDS Start-End: 110-551
agggctccgccgcgtgtcccctgagaacgcgagtttactatcgctgccgttttgcccttgggagtaggatgtggtgaaaggatggggcttctcccttacggggctcacaatggccagagaagattccgtgaagtgtctgcgctgcctgctctacgccctcaatctgctcttttggttaatgtccatcagtgtgttggcagtttctgcttggatgagggactacctaaataatgttctcactttaactgcagaaacgagggtagaggaagcagtcattttgacttactttcctgtggttcatccggtcatgattgctgtttgctgtttccttatcattgtggggatgttaggatattgtggaacggtgaaaagaaatctgttgcttcttgcatggtactttggaagtttgcttgtcattttctgtgtagaactggcttgtggcgtttggacatatgaacaggaacttatggttccagtacaatggtcagatatggtcactttgaaagccaggatgacaaattatggattacctagatatcggtggcttactc

SEQ ID NO: 190343 - DNA, 2093 bp, Homo sapiens
  Payload ID: 17603
  Gene Name: tetraspanin 13
  Uniprot ID: O95857
  ENST ID: ENST00000262067
  CDS Start-End: 434-1048
acctgctcctggggaaactacaccaaggccgccgctctggcctggggctccctcccacacggccttggccctctccccctcgccccgggaccgctccgcccctcccggatcccggtcggcggagcgcatttatttgcatatttctacctttgttccctgccagcggccaatcagcgcgcggggcgagacgaaggggctgggcggggctcgggctcctgctccggctcagctgcggcggccgcaggttccaaagcgggtccgagccgccgccgcgcgcgcgccgcgcactgcagccccaggccccggccccccacccacgtctgcgttgctgccccgcctgggccaggccccaaaggcaaggacaaagcagctgtcagggaacctccgccggagtcgaatttacgtgcagctgccggcaaccacaggttccaagatggtttgcgggggcttcgcgtgttccaagaactgcctgtgcgccctcaacctgctttacaccttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctatttttttatatgattattctgttacttgtatttattgttcagttttctgtatcttgcgcttgtttagccctgaaccaggagcaacagggtcagcttctggaggttggttggaacaatacggcaagtgctcgaaatgacatccagagaaatctaaactgctgtgggttccgaagtgttaacccaaatgacacctgtctggctagctgtgttaaaagtgaccactcgtgctcgccatgtgctccaatcataggagaatatgctggagaggttttgagatttgttggtggcattggcctgttcttcagttttacagagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagattgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaatttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaagaattgatcgatgaa

SEQ ID NO: 190344 - DNA, 1037 bp, Homo sapiens
  Payload ID: 17604
  Gene Name: tetraspanin 14
  ENST ID: ENST00000341863
  CDS Start-End: 35-676
gccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctcca

SEQ ID NO: 190345 - DNA, 1380 bp, Homo sapiens
  Payload ID: 17604
  Gene Name: tetraspanin 14
  Uniprot ID: Q8NG11
  ENST ID: ENST00000372156
  CDS Start-End: 503-1315
gggcaggctggggttgaaactcttcaccccttgcggtctgtactgcctcccaactgagcagccagggagaaggcctagagcctgtgcctttcagctagatagctggaggaactggctcctccctccttaggctgtgctggcctgagctgggagcctgagagctggggcagttgtctctaaagtggcttctgggattctggtaagaggacttggggtggagtcgaaagcagggagccctgtgagttgagacgaactcttgcaatgttgccttggctggtctcgaactcatcttctgggttcaagctgtccgtctgcctcggactcccaaagtgctaggattacagcgttacatccttactattcaaagtgccatccacagacctgctgatgggcagcatgagcatcacctgggagcttgctgcgctgtagaatcttgaggggtctccatccagatcagctgaatcagagtttgcattgttaacaagattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagc

SEQ ID NO: 190346 - DNA, 855 bp, Homo sapiens
  Payload ID: 17604
  Gene Name: tetraspanin 14
  ENST ID: ENST00000372157
  CDS Start-End: 187-855
acttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagtgctgccctgctttctctgtctctttcagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctg

SEQ ID NO: 190347 - DNA, 1095 bp, Homo sapiens
  Payload ID: 17604
  Gene Name: tetraspanin 14
  Uniprot ID: Q8NG11
  ENST ID: ENST00000372158
  CDS Start-End: 218-1030
ctgccgccgccgcgcgcgggacttggggtggagtcgaaagcagggagccctgtgagttgcgttacatccttactattcaaagtgccatccacagacctgctgatgggcagcatgagcatcacctgggagcttgctgcgctgtagaatcttgaggggtctccatccagatcagctgaatcagagtttgcattgttaacaagattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagc

SEQ ID NO: 190348 - DNA, 5476 bp, Homo sapiens
  Payload ID: 17604
  Gene Name: tetraspanin 14
  Uniprot ID: Q8NG11
  ENST ID: ENST00000372164
  CDS Start-End: 60-821
ggccgagccgggccgcgccgccgctgccgccgccgcgcgcggattctgcttctcagaagatgcactattatagatactctaacgccaaggtcagctgctggtacaagtacctccttttcagctacaacatcatcttctggggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccggtcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactactagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaatgtaaa

SEQ ID NO: 190349 - DNA, 16183 bp, Homo sapiens
  Payload ID: 17604
  Gene Name: tetraspanin 14
  Uniprot ID: Q8NG11
  ENST ID: ENST00000429989
  CDS Start-End: 224-1036
ccgcaccgggcggcgcagggaagcggcgccccttcctcggcagacggcaggcgccgcgcctccggccccgcccctccgcgcccctccgcgccccgcccccgccgctcggacggcccgagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccggtcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactactagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaatgtaaagtgaaaagtgaaagtatgtcttctgttacgcagaggtaactactattaggaatccttcctgaaaatgtccatgcatctactcaggtcatcacacccatggaatcattttacatactattttatgagtgttacttaatatactgatccacagtgcgttttcacggtcacgccatcagttgtaggagtgtgccaagaacagatgggccttgcctttgtaccagaggagtccatttacagttgcaggtaatagaaaacccaattcagactggcctaaacaatgaggggaggttttggctcttgaaactggaaagtcccaaggtggggtgagtttcaggtttgggttgatccaagtggctcagtgacgtcaacaggatcttgtttccatttctctgccttccacagcctccccttcatctatggtggagggaaggagtctaccacagacaaaccccgagcctccccctgatgggtggtgtggtggtgaagccagcaagggaagggatccccggacacacccctcctcatgctttatcccactgaaaccatgcggctgtgaaatgcagcatcctccaggagggggatgaaggccggggatgctgtcagctattgccattgcacttctgtggatgggtgttacagttttttgcagggttttgcacttacaaggacatatatatatatatataaactacagtgttattggaattgcttcttacagtttgtaagaaaaaaacatgtttttagaggagttctcctgggaggtgggatcacatttttttttttttttttttttgagacggagtctcgctctgtggcccaggcgggagtgcagtggcgcaatctcggctcactgcaagctccgcctcccgggttcacgccattctcctgcctcagcctcccgagtagctgggactacaggcgcccgccactacgcccggctaattttttttgtatttttagtagagacggggtttcaccgtgttagccaggatgggggatcacattttaataagtaggtactcagggctggggtgtacctgttgctgcctgaccactgctggtgtgtgtgggtataaggtgacaaaacctcctacccctgtgaggttgtttcaaggattaaatgagttgagatgggtaagcatctaacaaagatccagattatttagtatgcatcccctgaattattgctaacataattttaatgattggggaattttatctgtggctgccagtccctacgagagagctgcctgggtcacatgtcagatagctcaagctttgaatcactgaaacgaaacggtccacttccctgtccctttaggaacaaggcttcgaggtctgtggcaagcctcagcaggcatttggagttcaaggtctgttctctttctgtgccatagaggtggggagacaaggtagggtgttgcttcttgcctggagcgcagatgctaccagaaaccaacacaaccaaagttgcccgggagcccccagaagcagcagagtggccatcaactgccaaggggccagggtaggccacagaggcctggggcccaggagggatggtctgtggggagaaaggggattattgtgaacatcaacgctggggataatgtgccctgaagacagcagcatatcacgtttggacggttggtggaccccatctggtcccactcataaggagaacagaggccctggggtgtgctgggacttgcctgaggcctcagaccgggactgggtgctcctccgcacctcctatgagggagggtgtccgtgtctgtgaggacagctcagcagggctgggaacctgggggcagtgctgggggacatgtgtgagactagcgtgtgtgggccttgctcggcttgccctggtgccctgagaaaaacctggtatttgaaaatacacatggactgctggaaggtcaggaaatccagggttttgttctgaggcagtggaagtgttaccgtgagcctgtgttggcctctctcctcactccacctgcagccaattcagccacactgcctttgcatggaacccagggttgcaggccgcgtgtgtagatgctgatttaggcccaagcactcagctgtcagcaggaaggaccatagtgttttcttctagttttagatatgcactcgttctgtgttttaaagtcacagctgtgagccaatatgggaagaagtgaagtggcctctaggagggactgagcaccctgtccttggaggtatgcaagcccaggctacacccttcctgtctgggatgatatggctgggggtgggctttgtgctgcgtggaccatggcaagcctttccatctctgagaggtagtggtccttcccgtgccttctgttaaagataattttttaaaaaaaggcataactcatatatattacatgtacacatgtcaaagattttatttaactcagtaattgagagtgctgctaagattaacagccagttcaaaagagaaatcacaatgaaccataaatctgtatggagtaaaggaaagttgaaactggctggggtttttttttttttttttttttttgaggagaaaggtcaattgaatcttattcgtataatatgcacatccatagacaagaattattttgcattaactctacaacttagttgtaaaaatagctcaaaggcagtgaaagactagaatcagataattggaagggtgcaccctaagcaatgcatagttctattttctttctttttttttttgagacagagtttccctcttgtcacacaggctggagcgcagtggtgcaatcttggctcattgcaacctctgcctcccgggttcaagtgattctcctgactcagcctcctgagtagctgggattacaggcgcatgccaccacaactggctaatttttgtatttttagtagatacagggtttcactgtgttggccaggttggtctcatactcctgacctcaggtgatccacccgcctcggcctcccaaaatgttgggattacaggcgtcagccaccacgcccggccccaatgcatagttttttactgaagacaaccagaatctctgttgcttattccaaatttccttccaccacttgtccatccagcagagccacttttaaaataggacacaggcagaaatttaaaggagtcaatatctcatggtgaaaagtgaatcctgagggttagagcatccaccaggtgccctaggtaagggccagccactctgggaggcagcccggggcactcactgtcctctcagtagtaaatgaaatcactcaggccatgtctgctacccagagagcctgagtgtcctcaaatgcttgttctgcctctccatccactcctgcagacacctcagtggctgcatcccaaaccgctgaactttgcttctctttctccaacccccaattccacccacatccaaaactgctctgccccctattcccatctcagctgagggtactatcatccaccctgtggccacatccaggaatgtgtgtatcacctgggctctgaggatgacatcagctcttctaagtcaacagaatgtcgggtctgttctaaaagtctcatctgacaaggagatctttaaggctttactcccttaaaggctttactcccatcatgatgggataaccatcatgatggatttcagtgtcattctgtctttttcttcggaatgattcctgggactcgccttgtttgcaacatgtgcattgaaatatcttttcaacataactttgttcttaattgtgtttacttcctttctctgtgaatctcagtgattcctggaagctgtggttggtgggggatggggtgggaggactttggtagtataaaagagtacctgcaatgaatgttctaagaaactggagtgttggggtcctccagcccttggctggtaaactctccactccttcctctttgcaacacaattctcataactggcaaaggtgtgcatgtaaaatttgtgactgtagtctgaggttttttttccctgtacaattccgccttcccccctgtaagcctgtaccaggagaggtctcagctgccttggaggcggtgagacacgtgggtgctcactgtggccctcaagggtgaggctggcactggggcatctggggccagaagtcctcctttagtcccaagtctctgccactcaagtgcatcagtgagaggtcctcatagaaaatctactgtgggcacaaagctgccaggctgatgggggtggggagcaaacgaacacccttttccccttttacaccagaggaaagagacttagactgaggaacttgcctgctgccagacagctgggaggtggtagaaccgggcttacagcccagggtttccactctaggaactcttctcccttcctctgatgacactaactcgcaggccatgatcaatgagcaacgatgtaggcaggcactgacgaggcacagcaggaaggcagctcagtgcccatgacggccaggaactgggtaccatttcctcagcaaaatgggatagtaactcccacactgcagctacgcacttgggcagtggttcacaaggccagcagccacaacatcaccccagaccagcagcagctgcagcattacccccagcacttgttaaaagatgcaaattcaggccaggtgtggtggctcgtgcctgtaatcccagtactttgggaagccaaggcgggtgggtcacctgaggtcaggagttcgagaccagcctggccaatgtggtgaaaccctgtctctactaaaaatacaaaaaatgacccgggcatggttgtgggcgcctgtaatcccagctacccaggagaccgaggcaggagaatcacttgaacccgggaggcagaggttgcagtcagccgagattgtgccattacactccagcctgggcaacaagagcgaaactctgtttcaataaataaataaaaatgcaaattgtatgccccttccttcaggcctatgggaccaaaaactgggatggggcccaataaaatgttttaaccagcccttcggtggttacagaaggatagagccagaatagactaaccactgtaacaaacattacctatacttgggaggctttgaaaaatgtttatttagccgggtgcggtggctcacgcctgtaatcccaacactttgggaggctgaggcgggcggatcacgaggtcaggagattgagaccagcctggctaacacagtgaaaccccgtctctactaaaaatacaaaaaattagccaggtgtggtggcaggtgcctgtagtcccagctactctggaggctgaggcagtagaatttcttgaacccaggaggcggggcttgcagtaagtcgagatcacgccactgcactccagcctgggtgacagagtgagactccatctcaaaaaaaaaaaaaaaggaaagaaaaatgtttatttttttgctcatgccacagtctctggtagttgctgggaactagggtgggggattctctgctccacacagtctttcatggacccaggttcctttcctgttgtgggtccagcctcctgtagctgttggaggcatctctagtcagctggtggttggggaagaggtgaggatcagggagggaagatggagagtactctgcttgttctcacattctgctggccagaactcacaagccacctgaaatgatgcaaaggtctagctgtgtgtgtaggagaaagaagagaggccagatattggaagacagcagtggtctgtgccccaggccccatggtttagggaagtgaaccttggcactggatttcctggctttctaaatctccctttatagggaacttagggcccagtctgtggtgggtggatttgcctggttcacagcctctggtcagccttctttctgctccacagggcggcctggagatggtgggctccttgtcacactggttggggatgtgggctccatggggccagagatgtgtgtgctctgtgttcagattaagggacagacggcacatgaattccttcagtgccctccagatttggtcactggggaggggtaggctgagcagtagctcttgggtctgtagtagtgtgaccctggaaggactgtccagctgaaaacaagagcctggggcgtggggaggggaggggttactcagggttccatgagacctgggtttaagtcctggatccatcattagcagctatgtgaacttatgcctcactttcctcaaatatgaacttgagataatgaaattaccttcctcataatactgttctaagaattgaatgaggaaaggtttacaattcggccctggttgttccactggggagggaacagagattgggggcacagggctcccctggcctgggggagtctggctcactcaagttctcagtcatttgcaaggcaaggaccctgcttctccttgctctgggtccgagtagtctcaagcccagtgggcagggcctgtggtgtggatggactcgtctgcagtgagtcaggcagcaggcagagctggcaggctgtgtggtctctagtgggtaccaggggacctgggagggccttgtgggaggttgtccacggtgtgagccagtttgccatctggggtcctggagttccctcccgccctttgagttaaaaagagtcagtcctgggctgagacttaattgcgctagtgctgagtgaccttgtgtcaggggaaatcggatggggcaaagtgttttttaattagcaggactcactgacctttccttcactgtcagcaacttctcacagggaggcagagcaaggggggctggagccccgcatctctctaatggagcctatgtccaacaaggaggtggatggctggattcagggccctgggaggacttcatgtgggaagcagacctcaggaagggcccttagtgatggtgtgggccagggttctcacctccttagtctcctgtcctgtccatctccgcagatcctaggcaaaagaagcggagaaacactcaagccactggggtggttagggcacactggtggcaactgtttaaaaccttaactaaaacaaggttaagcaaaaggagtttacaggctctcatagatgggaaggatgtgggagggtcacagactgagaggaaccagggctgtggctgctggaaggagcctcaccaccgccagtgtgtttcctccccgtcgtcggcatctctgcttctctctgcacgccagcagctctctcttagggcacgcagacctttcctctgcaggggaacacgagtgccggcagccccgagttagtgactatcatagaaactcagtgtatttctctcttgtttatcattccgagtcctgagtcacaggcttgtccagcactcaagactttttcttttctctattttttgaaacggattctcgctctgtcccccaggctggagtgcagtggcccgattttgggtgcaagcgattctcctgcctcaacctcccgagtagctgggactacaggtgtgcgccaccacatccagctaatttttgtatttttagtagagacggagtttcactatgttggccaggctggtttcaaactcctgacctcccgccggcctcagcctcccaaagtgctgggattacaggcatgagccaccacgcctggccaagattttttcttttaaacctggagtatggagatgctcactaggcagacagaatcagccaccacagcccactccctcagccagtattactttgactaagttagtgaggaaccaggccccagattaagaagcagaactcacactgtcatctgctgtgtgcctggctggctcatgcataccttgtctatctaatgtggaccaaagccctgtggcacaccctgctggttacccccagtggttaccctggcacagaggaggaaagggagtcgtgggagggagaaggacttccctgggaggtctctgggctggcaagttgggtgacacaggtccggttggctgcaagcctgggctctgctgttgtaatcataaatgtgtgtgtgtgtacagttgtttacaatgtcagcatgggtgtccttgtttgttagagatacatgccactgctcccatcatgaggaaaatcccaagccctccccatgatttttgccagtttctggggactcatgctcctggcagcccatgtgtccccaactcctgtgtcctttagggacctctgttgagccctgcctctattctggcagaattagagaaaattctttaaaaaaacaataaagtttaaattcatttaaaaaaataataaaaaatctcacagcatgagttttgatgagatttggggcaaggtgggccacaaccttgggttgtatggccacctccccctcttcttcccctgttgtctctgcagctcagaaaccccaatttcctggcctgtgttatgtggaggagctgagctcaccccctacagcttcatctccaaacctagcaaggatcctgcccagatcaggagatcctccttttaacagaagttatttacactccttagaaagcagtgggggtggaacgattctttttcctgatgcagagatgtaaaactgggacattgctacacataatattttaaacctgtcttccctcttaccaacgaacacatcactagcaccatctatgccaatacatttctcaacatcaatttcagtggctgtattacattttatcctacggatgtgctctcatttataatctaaaccacttttattgaacacatcagttattctgaaattttcagtgttatgatggatgttgcagtaattattcttatatatgcacagaacccccagaggacatgactactgaaggctgtgctggcaggatcacaggtaaggatctagcaaattgtcccagcttcattgactgagctttcatccttgttgcactactttgagctgccattttgatcatataataatgatttagtagagctcttttttggttcaacctacctgttcttgtatcagaactgaaatgtttgattttataaatttgaatagtggcacaatatagagttcactattcctcaatattttcaaggctgtttcttatctgttcattcttttggttaacttgggaattattttatcaagtctctctacttcccaatttcctttcacctttggctcgaaatgatattcaatgtatacattaacttgagttacattttgctgcataatgcttgagttacattttgagtattacgtgttactcataatacatattgagttacattttgctgcataatacattatccccaagtttaacaccttaaagcagcacatatatatctcatacccttctgagggtcaggaatctagaagcagcttagctgggtgactgtggctctgggtctctcatgaggctgcagtgaaactgttggccagggctggaggatcccttccaacctcactccatgactgttggtgggaggcttcagttctccacctggttctcacaatataatttcccccagagtgagttatcagagagagtgtgcaaccagtaatctgttagaatatgtcacgtctgtcatatttgattggtcactcagaccaaccctaatagatgcgagagtgactatgcaagggtgtgagttccaggaggaaagcatcattggaaccatcttggagactggctaatacacagataaatggcacatctgacaatatggcatctttctgagtgtcagtgtggtgtgttcctatatgaacttaatgctattaaacttaattaaattgtaggtatgctctcagtgaagatttttacttttacattacaggtttccacactgttaaattcattccaagtatttcatacatgctgttcctattatgaaaggatcttttttttcacatggcattttctaagtagttgttgcattcatataggagatgctattgattttgacacccataatttttcagtggagacaaggcagaaactactccagactctcacctgctgttgctgatccttacatggtggctgtgccaggctcagccgcgctgagatgacagggctgtctggccatcattggtcatatggacttcagatttgaaaggattttatgtagaagcagagtgcctgataggactctccgggacccccatttctgccctgcttggctcccactggcaaggctggctcagttcctgtcaccttctcctggactttggccagagtccactggctgtttcccctgcctcctgctctcccagtgccctctccacaccagtgccagagctgcttctaagagatgcctcaaagcccgcttccagcttaggaaccccagggaacatggatggtttctccattgccacttcctagccttcctggcataggaaggtctggtttgcctgcaggtccctctctgggggggtccctgctccatagatgctgaggctccagaagtctgttcttttatatcacatttgaaaacctttgaaatgcattatagttgagtcatatgaattatgtaagtatatcctactcattgtataaaacaacacagaattgt

SEQ ID NO: 190350 - DNA, 808 bp, Homo sapiens
  Payload ID: 17604
  Gene Name: tetraspanin 14
  Uniprot ID: Q8NG11
  ENST ID: ENST00000481124
  CDS Start-End: 125-568
cgccgctcggacggcccgagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatg

SEQ ID NO: 190351 - DNA, 2436 bp, Homo sapiens
  Payload ID: 17604
  Gene Name: tetraspanin 14
  Uniprot ID: Q8NG11
  ENST ID: ENST00000616406
  CDS Start-End: 23-784
cgcagattctgcttctcagaagatgcactattatagatactctaacgccaaggtcagctgctggtacaagtacctccttttcagctacaacatcatcttctggggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttacacaattctctgtagactaggagaagaatgcttgtgtttttcggaagtgtgatgcttctctttgactgccaaactcttttatggaatatatctttatatt

SEQ ID NO: 190352 - DNA, 1698 bp, Homo sapiens
  Payload ID: 17605
  Gene Name: tetraspanin 15
  Uniprot ID: O95858
  ENST ID: ENST00000373290
  CDS Start-End: 123-1007
cggagagaacgccggtggcggggctggtagcccggcagccgcaggtggggccacgagcgctggctgagggaccgagccggagagccccggagcccccgtaacccgcgcggggagcgcccaggatgccgcgcggggactcggagcaggtgcgctactgcgcgcgcttctcctacctctggctcaagttttcacttatcatctattccaccgtgttctggctgattggggccctggtcctgtctgtgggcatctatgcagaggttgagcggcagaaatataaaacccttgaaagtgccttcctggctccagccatcatcctcatcctcctgggcgtcgtcatgttcatggtctccttcattggtgtgctggcgtccctccgtgacaacctgtaccttctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagttcctgggggtgctgctgacgctgctgtacatcacccgggtggaggacatcatcatggagcactctgtcactgatgggctcctggggcccggtgccaagcccagcgtggaggcggcaggcacgggatgctgcttgtgctaccccaattagggcccagcctgccatggcagctccaacaaggaccgtctgggatagcacctctcagtcaacatcgtggggctggacagggctgcggcccctctgcccacactcagtactgaccaaagccagggctgtgtgtgcctgtgtgtaggtcccacggcctctgcctccccagggagcagagcctgggcctcccctaagaggctttccccgaggcagctctggaatctgtgcccacctggggcctggggaacaaggccctcctttctccaggcctgggctacgggggagggagagcctgaggctctgctcagggcccatttcatctctggcagtgccttggcggtggtattcaaggcagttttgtagcacctgtaattggggagagggagtgtgcccctcggggcaggagggaagggcatctggggaagggcaggagggaagagctgtccatgcagccacgcccatggccaggttggcctcttctcagcctcccaggtgccttgagccctcttgcaagggcggctgcttccttgagcctagtttttttacgtgatttttgtaacattcatttttttgtacagataacaggagtttctgactaatcaaagctggtatttccccgcatgtcttattcttgcccttcccccaaccagtttgttaatcaaacaataaaaacatgtttttttttttttttttt

SEQ ID NO: 190353 - DNA, 575 bp, Homo sapiens
  Payload ID: 17605
  Gene Name: tetraspanin 15
  ENST ID: ENST00000452130
  CDS Start-End: 1-483
ctccaagcattcatgtacatccttgggatctgcctcatcatggagctcattggtggcgtggtggccttgaccttccggaaccagaccattgacttcctgaacgacaacattcgaagaggaattgagaactactatgatgatctggacttcaaaaacatcatggactttgttcagaaaaagttcaagtgctgtggcggggaggactaccgagattggagcaagaatcagtaccacgactgcagtgcccctggacccctggcctgtggggtgccctacacctgctgcatcaggaacacgacagaagttgtcaacaccatgtgtggctacaaaactatcgacaaggagcgtttcagtgtgcaggatgtcatctacgtgcggggctgcaccaacgccgtgatcatctggttcatggacaactacaccatcatggcgggcatcctcctgggcatcctgcttccccagataacaggagtttctgactaatcaaagctggtatttccccgcatgtcttattcttgcccttcccccaaccagtttgttaatcaaacaataaaaacatgttttttttttttttt

SEQ ID NO: 190354 - DNA, 1040 bp, Homo sapiens
  Payload ID: 17606
  Gene Name: tetraspanin 16
  Uniprot ID: Q9UKR8
  ENST ID: ENST00000316737
  CDS Start-End: 151-888
tggacaaccatcaggcagccaggacacagaggggcagagcaagtcagcattggcgccccttcctcagatccctatcatcttgggaaacagtagcccagaggttcaggaagatgttaacttaaatgttcagggtgccccagtctgttcagcatggctgaaatccacactccgtattcttccttgaagaaactgttatctttactcaatggcttcgtggctgtgtctggcatcatcctagttggcctgggcattggtggtaaatgtggaggggcctctctgacgaatgtcctcgggctgtcctccgcatacctccttcacgttggcaacctgtgcctggtgatgggatgcatcacggtactgcttggctgtgccgggtggtatggagcgactaaagagagcagaggcacgctcttgttttgcatcctgtcaatggttattgtcctcatcatggaagttacagctgccacagtggtccttcttttctttccaattgttggagatgtggccttggaacacaccttcgtgaccctgaggaagaattacagaggttacaacgagccagacgactattctacacagtggaacttggtcatggagaagctaaagtgctgtggggtgaataactacacagatttttctggctcttccttcgaaatgacaacgggccacacctaccccaggagttgctgtaaatccatcggaagtgtgtcctgtgacggacgcgatgtgtctccaaacgtcatccaccagaagggctgtttccataaactcctaaaaatcaccaagactcagagcttcaccctgagtgggagctctctgggagctgcagtgatacagaggtgggggtctcgctatgttgcgcaggctggtcttgaactgctggcctaaagcgatccccccgcctaggcctcccaaagtgctgggtttaccagcgtgagccaccacgctgggcttcctgcatccttttaaggttcctgagggtctgcctgagaggagctgtccctgaatctccatgcagccccacctgccacatcaccaag

SEQ ID NO: 190355 - DNA, 1026 bp, Homo sapiens
  Payload ID: 17606
  Gene Name: tetraspanin 16
  Uniprot ID: Q9UKR8
  ENST ID: ENST00000337994
  CDS Start-End: 130-612
ggacacagaggggcagagcaagtcagcattggcgccccttcctcagatccctatcatcttgggaaacagtagcccagaggttcaggaagatgttaacttaaatgttcagggtgccccagtctgttcagcatggctgaaatccacactccgtattcttccttgaagaaactgttatctttactcaatggcttcgtggctgtgtctggcatcatcctagttggcctgggcattggtggtaaatgtggaggggcctctctgacgaatgtcctcgggctgtcctccgcatacctccttcacgttggcaacctgtgcctggtgatgggatgcatcacggtactgcttggctgtgccgggtggtatggagcgactaaagagagcagaggcacgctcttgttttgcatcctgtcaatggttattgtcctcatcatggaagttacagctgccacagtggtccttcttttctttccaattgttggagatgtggccttggaacacaccttcgtgaccctgaggaagaattacagaggttacaacgagccagacgactattctacacagtggaacttggtcatggagaagggactctccaagtatttcttctcctctctatagctaaagtgctgtggggtgaataactacacagatttttctggctcttccttcgaaatgacaacgggccacacctaccccaggagttgctgtaaatccatcggaagtgtgtcctgtgacggacgcgatgtgtctccaaacgtcatccaccagaagggctgtttccataaactcctaaaaatcaccaagactcagagcttcaccctgagtgggagctctctgggagctgcagtgatacagttgccaggaattcttgccactttgctgctgtttatcaagctgggctgacacccaggcctggagaagatgagacacctgggcccatctggctgctggagattcagtctcagttttatttctctgtggcactcactgcttctggaggggagactgttaataaaagatttgggaaccccc

SEQ ID NO: 190356 - DNA, 417 bp, Homo sapiens
  Payload ID: 17606
  Gene Name: tetraspanin 16
  ENST ID: ENST00000589928
  CDS Start-End: 1-117
cgcgatgtgtctccaaacgtcatccaccagaagaaactgaggctcggggaggggacatcactagttcaagatcacagagctttggcagagttggaatttgaagccccattggcctgagtccattgccggcaccacactacctgccttctagagaccctaaatggagcaataaccatgaaaagtgatcatcctagcgggagtgagggccagccacgtgatggagcactcactttggctgtttccataaactcctaaaaatcaccaagactcagagcttcaccctgagtgggagctctctgggagctgcagtgatacaggtaagacccagcctctctagggtctttgagctgttttattaagcacctactgtatgccaaacactgttctggtcactgggacacaggagtgaacaaaact

SEQ ID NO: 190357 - DNA, 927 bp, Homo sapiens
  Payload ID: 17606
  Gene Name: tetraspanin 16
  Uniprot ID: Q9UKR8
  ENST ID: ENST00000592955
  CDS Start-End: 139-798
aggcagccaggacacagaggggcagagcaagtcagcattggcgccccttcctcagatccctatcatcttgggaaacagtagcccagaggttcaggaagatgttaacttaaatgttcagggtgccccagtctgttcagcatggctgaaatccacactccgtattcttccttgaagaaactgttatctttactcaatggcttcgtggctgtgtctggcatcatcctagttggcctgggcattggtggtaaatgtggaggggcctctctgacgaatgtcctcgggctgtcctccgcatacctccttcacgttggcaacctgtgcctggtgatgggatgcatcacggtactgcttggctgtgccgggtggtatggagcgactaaagagagcagaggcacgctcttgtttgttggagatgtggccttggaacacaccttcgtgaccctgaggaagaattacagaggttacaacgagccagacgactattctacacagtggaacttggtcatggagaagctaaagtgctgtggggtgaataactacacagatttttctggctcttccttcgaaatgacaacgggccacacctaccccaggagttgctgtaaatccatcggaagtgtgtcctgtgacggacgcgatgtgtctccaaacgtcatccaccagaagggctgtttccataaactcctaaaaatcaccaagactcagagcttcaccctgagtgggagctctctgggagctgcagtgatacagttgccaggaattcttgccactttgctgctgtttatcaagctgggctgacacccaggcctggagaagatgagacacctgggcccatctggctgctggagattcagtctcagttttatttctctgtggcactcactgcttctggaggggagactgttaataaaagatttgggaaccccc

SEQ ID NO: 190358 - DNA, 997 bp, Homo sapiens
  Payload ID: 17606
  Gene Name: tetraspanin 16
  Uniprot ID: Q9UKR8
  ENST ID: ENST00000590327
  CDS Start-End: 132-866
caggacacagaggggcagagcaagtcagcattggcgccccttcctcagatccctatcatcttgggaaacagtagcccagaggttcaggaagatgttaacttaaatgttcagggtgccccagtctgttcagcatggctgaaatccacactccgtattcttccttgaagaaactgttatctttactcaatggcttcgtggctgtgtctggcatcatcctagttggcctgggcattggtggtaaatgtggaggggcctctctgacgaatgtcctcgggctgtcctccgcatacctccttcacgttggcaacctgtgcctggtgatgggatgcatcacggtactgcttggctgtgccgggtggtatggagcgactaaagagagcagaggcacgctcttgttttgcatcctgtcaatggttattgtcctcatcatggaagttacagctgccacagtggtccttcttttctttccaattgttggagatgtggccttggaacacaccttcgtgaccctgaggaagaattacagaggttacaacgagccagacgactattctacacagtggaacttggtcatggagaagctaaagtgctgtggggtgaataactacacagatttttctggctcttccttcgaaatgacaacgggccacacctaccccaggagttgctgtaaatccatcggaagtgtgtcctgtgacggacgcgatgtgtctccaaacgtcatccaccagaagggctgtttccataaactcctaaaaatcaccaagactcagagcttcaccctgagtgggagctctctgggagctgcagtgatacagttgccaggaattcttgccactttgctgctgtttatcaagctgggctgacacccaggcctggagaagatgagacacctgggcccatctggctgctggagattcagtctcagttttatttctctgtggcactcactgcttctggaggggagactgttaataaaagatttgggaaccccctg

SEQ ID NO: 190359 - DNA, 642 bp, Homo sapiens
  Payload ID: 17606
  Gene Name: tetraspanin 16
  Uniprot ID: Q9UKR8
  ENST ID: ENST00000621731
  CDS Start-End: 160-642
gggccgccttggacaaccatcaggcagccaggacacagaggggcagagcaagtcagcattggcgccccttcctcagatccctatcatcttgggaaacagtagcccagaggttcaggaagatgttaacttaaatgttcagggtgccccagtctgttcagcatggctgaaatccacactccgtattcttccttgaagaaactgttatctttactcaatggcttcgtggctgtgtctggcatcatcctagttggcctgggcattggtggtaaatgtggaggggcctctctgacgaatgtcctcgggctgtcctccgcatacctccttcacgttggcaacctgtgcctggtgatgggatgcatcacggtactgcttggctgtgccgggtggtatggagcgactaaagagagcagaggcacgctcttgttttgcatcctgtcaatggttattgtcctcatcatggaagttacagctgccacagtggtccttcttttctttccaattgttggagatgtggccttggaacacaccttcgtgaccctgaggaagaattacagaggttacaacgagccagacgactattctacacagtggaacttggtcatggagaagggactctccaagtatttcttctcctctctatag

SEQ ID NO: 190360 - DNA, 2810 bp, Homo sapiens
  Payload ID: 17607
  Gene Name: tetraspanin 17
  Uniprot ID: Q96FV3
  ENST ID: ENST00000298564
  CDS Start-End: 150-716
ggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctggttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatacgaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccaggtacccttgtggccccacgtgcccctccccttgccggggccgccctcactctcccctcacctgtcctctgtcttacagatctttggcatctgcctggcccagaacctcgtgagtgacatcaaggcagtgaaagccaactggtgaggccgccagaggccatggccacatgcctggcctacgcaggcctctggggggccccccaggaccctcctactatactcctgacgggcaaggctgcaggagatgttcctgctgggactgagccttgaggggttcgcctgaaccgctgtgctgtccacccacggaggaagttgctgtgcctccgcctgggcctcttgtcccatatgcgtgtgtacacacacatgcaggcacacgtgtgcacagggagccaccgtctcggctacatttggggtggtggactctccaggggactaggaagggcgcagctcagagggtgcaggccaagtggggtgggaggtgctgtgtggagggtcccccccgttccctgccccccagtgctgggacgcacctttctgtgcgtagctgtatggggcgcgttgcctgagccactgcctcacacagcttcagagcactcttttctatgagctgtaactttgagcctgccaggaacccacctcagcctcagtgtcccagactctgaaatgggtccaagaattttctttctcttgcttgcctctcaggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttattccctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcaccgtggctgcagagctgcctgatgggcactagagggcatgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtgtggagtgatcctgccgccccctccctgggctcgtccagagatctcaaactccgatgcccctggggccacgtatgttgtataaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagcattg

SEQ ID NO: 190361 - DNA, 2550 bp, Homo sapiens
  Payload ID: 17607
  Gene Name: tetraspanin 17
  ENST ID: ENST00000310032
  CDS Start-End: 230-1228
ggcggggcccggtccagaggcggggacagcagggctccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggtgagaggggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttattccctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcaccgtggctgcagagctgcctgatgggcactagagggcatgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtgtggagtgatcctgccgccccctccctgggctcgtccagagatctcaaactccgatgcccctggggccacgtatgttgtataaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggttt

SEQ ID NO: 190362 - DNA, 2457 bp, Homo sapiens
  Payload ID: 17607
  Gene Name: tetraspanin 17
  Uniprot ID: Q96FV3
  ENST ID: ENST00000508164
  CDS Start-End: 115-1104
catgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttattccctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcaccgtggctgcagagctgcctgatgggcactagagggcatgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtgtggagtgatcctgccgccccctccctgggctcgtccagagatctcaaactccgatgcccctggggccacgtatgttgtataaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagca

SEQ ID NO: 190363 - DNA, 707 bp, Homo sapiens
  Payload ID: 17607
  Gene Name: tetraspanin 17
  ENST ID: ENST00000507471
  CDS Start-End: 1-611
ccggcaagcaccagcatttccaggaacctgaggtcggctgctgcgggaaatacttcctgtttggcttcaacattgtcttctggttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggtgaggccgccagaggccatggccacatgcctggcctacgcaggcctctggggggccccccaggaccctcctactatactcctgacgggcaaggctgcag

SEQ ID NO: 190364 - DNA, 884 bp, Homo sapiens
  Payload ID: 17607
  Gene Name: tetraspanin 17
  ENST ID: ENST00000504168
  CDS Start-End: 112-884
gaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactg

SEQ ID NO: 190365 - DNA, 1019 bp, Homo sapiens
  Payload ID: 17607
  Gene Name: tetraspanin 17
  ENST ID: ENST00000503045
  CDS Start-End: 56-985
ggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttgactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggtgagaggggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctct

SEQ ID NO: 190366 - DNA, 909 bp, Homo sapiens
  Payload ID: 17607
  Gene Name: tetraspanin 17
  ENST ID: ENST00000503030
  CDS Start-End: 115-291
catgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgagcgcggggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatacgaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggagcaaatggaatgatgactttgaaaaccactggcttacgcccaccatttccgaggtcctgtccacggcggggcctcagcagaactctctgactggggccc

SEQ ID NO: 190367 - DNA, 2361 bp, Homo sapiens
  Payload ID: 17607
  Gene Name: tetraspanin 17
  Uniprot ID: Q96FV3
  ENST ID: ENST00000515708
  CDS Start-End: 49-840
ggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttattccctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcaccgtggctgcagagctgcctgatgggcactagagggcatgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtgtggagtgatcctgccgccccctccctgggctcgtccagagatctcaaactccgatgcccctggggccacgtatgttgtataaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagcatt

SEQ ID NO: 190368 - DNA, 4229 bp, Homo sapiens
  Payload ID: 17608
  Gene Name: tetraspanin 18
  Uniprot ID: Q96SJ8
  ENST ID: ENST00000340160
  CDS Start-End: 240-986
agtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccagtgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccccagcaactggcccaggatgcaggctgctctagagaccaaaggaacaccaggcccagcgccctctttggtccagccagaccctgggccctctctcctcactgcaccaggacctgatgccaagaaagtgaggatttaggcaacaaggaggcaaaagcaaatctcagagaagtcatcaaagcccaggggctgcacggagattcagctgccatgtctttgaggactcggaacccacagcgcaatccctggtccactggaggatggactgttccccccttcaggccggggccaagagtgagctgctaacacggcatccaagaatggcccagctggtaggatccttgctttccccatctgttggaccaaataatctcaaaggcccagagaggacagtgaccatccacagacacacagcacaggcgtgacagttctgaaaagaagctgagttgtctccaggctgctgtcactgcatccaggactctgtcagctctgctgcccacatgcacccctggcctcagcatcccggttcccccagacaagagagggcaagtcagccaggaactgcctcctccctgctctacagctaagaaaacaccattccatgacttcccaccgcgccctcgctcctacctccccacacctctctctgagtccccaggaacacacagaggtgcacatcacattcccttgtccacactgcccgcctctcccacatgccacccccttccctgtccttccccaactccccagctccaagagtggaagaaatccccaagatcatctgggtctccctctccacacccagaactgaggcttggatatcttcttcaacatccttgccaagacttctccaccctcttgcatacctccagggacagagagcttactacctcccaaggcagcctcctgcctttggactgctctgactttagcatcagcttaatacacagaagaggtttctgtttttctgtggctctgtccatggcatcccacttgcccactctccttcctggagtgttgaggtcacacattgactcccctgagccctcttctctccaggctaaagaatcccgaaggcatcgaggccatttctgctgcaacaaggtttcctgtctcttcactgtccgcacatttcttagtattccctccaggcttgggcagggagactcgcagatgcacacccacaagtattcagttctcaaactctagacgagtgttggcaactggattgcaagatgctcctaccctgatagatcaggggtggctgctggaggctgtgctggggatctgaggtttggtctgggctcagtgggagacggcagtgcaatcctgatgagtgatgtctgccaggcaccgtaagtttgattagtgatgtctgccacgggcagggatggaaggagcagtgtgatgtctgctctcttctctcccctctgtccctcttcaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtgttaccaaattcgccctttaacagcttgctctggcaaccccataaatgacacctgaggtccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaacaaaaacaaaaaacaaaaaacccatgctgggcaggactgaggcaaattgcacagctttatggctctaatccaggggcatcccaggcttctggggcccacagaagtcagagggaggacccaagagaaagggctggtcatgaagggaaatctggctaaggtgggttcaagggcagacacaagactgcccctcagcagctttctacaaatgtgccaaggaaccctcaatcagccctgattcagctcgccagccagccactggccaccctcttaggctggaaagggaagacaggcagtttctgctcctgttggcattcgctcaggctggtagctatttgcaagactgcctgaggccattccttggaggcaaggcaaagaaagctcagcccaaatcaggcttgagcctccctccagagcacagggagaaacagggtttagctggcttggtccagatacaacccacagcaggttctggtggtggctggggttgtgggggaggggtgggcagggatacctctttgtttcttttcaccccgaaatacaacagcccataacagagacttcctcggaccccactaacagggcaaggaacaagaagactacaccgctcatcacaaaccctgcctgtatcgaaagccactttcctgctctgaagctactgcctcttagagaaagggaatagctctttatgggctgggggtgagggcccctccccagggtccctgttaatttctggccttggtgctcaggcctgtccacagcctcccttgtctatgtctctatccatgcttaaggggcccggacaggatttcccaaaccagccgaggccccagcacccgccgtctccccagaagccccctcctccttcccccatgggtcatatgttgaaagtctattttaaaaactatgttccttgccgtagattgcagagctaatttatcacgtttctctcctgtgagaccccccttttatatgatatatccagaggaagttttgtaatataaaacaggacgcccacactgatggttttgcactggtttttgtgaatgtttcttacaaaaagaaaaaggaacaaagaataaatagtgaccgtg

SEQ ID NO: 190369 - DNA, 871 bp, Homo sapiens
  Payload ID: 17608
  Gene Name: tetraspanin 18
  ENST ID: ENST00000520999
  CDS Start-End: 401-871
cgccgggaaggcagccggcgccgggcaagttgcgagcgcgcccctccgaccaggaaagtttccccccggccgccggcgggatttggcgcggggtccggcagccgccgctggaagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccagctgggccgataaaagaaatatacacaagcctcgctgacgggagagtctgtcctgctgatgcccgaagaactgcccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacagtgagtgac

SEQ ID NO: 190370 - DNA, 1184 bp, Homo sapiens
  Payload ID: 17608
  Gene Name: tetraspanin 18
  ENST ID: ENST00000518429
  CDS Start-End: 1-814
gtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtgttaccaaattcgccctttaacagcttgctctggcaaccccataaatgacacctgaggtccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaacaaaaa

SEQ ID NO: 190371 - DNA, 3316 bp, Homo sapiens
  Payload ID: 17608
  Gene Name: tetraspanin 18
  Uniprot ID: Q96SJ8
  ENST ID: ENST00000520358
  CDS Start-End: 416-1162
cggccccgagccccgagcgagcgccgccgcctcgcgctgcgggtccccggacgcgccgccaccgccgggaaggcagccggcgccgggcaagttgcgagcgcgcccctccgaccaggaaagtttccccccggccgccggcgggatttggcgcggggtccggcagccgccgctggaagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccagtgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccccagcaactggcccaggatgcaggctgctctagagaccaaaggaacaccaggcccagcgccctctttggtccagccagaccctgggccctctctcctcactgcaccaggacctgatgccaagaaagtgaggatttaggcaacaaggaggcaaaagcaaatctcagagaagtcatcaaagcccaggggctgcacggagattcagctgccatgtctttgaggactcggaacccacagcgcaatccctggtccactggaggatggactgttccccccttcaggccggggccaagagtgagctgctaacacggcatccaagaatggcccagctggtaggatccttgctttccccatctgttggaccaaataatctcaaaggcccagagaggacagtgaccatccacagacacacagcacaggcgtgacagttctgaaaagaagctgagttgtctccaggctgctgtcactgcatccaggactctgtcagctctgctgcccacatgcacccctggcctcagcatcccggttcccccagacaagagagggcaagtcagccaggaactgcctcctccctgctctacagctaagaaaacaccattccatgacttcccaccgcgccctcgctcctacctccccacacctctctctgagtccccaggaacacacagaggtgcacatcacattcccttgtccacactgcccgcctctcccacatgccacccccttccctgtccttccccaactccccagctccaagagtggaagaaatccccaagatcatctgggtctccctctccacacccagaactgaggcttggatatcttcttcaacatccttgccaagacttctccaccctcttgcatacctccagggacagagagcttactacctcccaaggcagcctcctgcctttggactgctctgactttagcatcagcttaatacacagaagaggtttctgtttttctgtggctctgtccatggcatcccacttgcccactctccttcctggagtgttgaggtcacacattgactcccctgagccctcttctctccaggctaaagaatcccgaaggcatcgaggccatttctgctgcaacaaggtttcctgtctcttcactgtccgcacatttcttagtattccctccaggcttgggcagggagactcgcagatgcacacccacaagtattcagttctcaaactctagacgagtgttggcaactggattgcaagatgctcctaccctgatagatcaggggtggctgctggaggctgtgctggggatctgaggtttggtctgggctcagtgggagacggcagtgcaatcctgatgagtgatgtctgccaggcaccgtaagtttgattagtgatgtctgccacgggcagggatggaaggagcagtgtgatgtctgctctcttctctcccctctgtccctcttcaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtgttaccaaattcgccctttaacagcttgctctggcaaccccataaatgacacctgaggtccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaaca

SEQ ID NO: 190372 - DNA, 565 bp, Homo sapiens
  Payload ID: 17608
  Gene Name: tetraspanin 18
  ENST ID: ENST00000520837
  CDS Start-End: 338-565
agaaccaagaagcatttgtctgctgaggcccaagactgggtagaggtggtgagcatcgtcccccgtccgccaccacagcatgcaacaggctcctgctatgctcctggggctgctccagtctgacagctacagaagagggtgagcatctcctggaccaccctcaagcttcaggtgagctgagcttctaacactaccatcaaagcaactggaaccccttgaatttgatttctggagacgcgagcataatccttttgcagacatctcaacgctggctctccagctgggccgataaaagaaatatacacaagcctcgctgacgggagagtctgtcctgctgatgcccgaagaactgcccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctcttt

SEQ ID NO: 190373 - DNA, 840 bp, Homo sapiens
  Payload ID: 17608
  Gene Name: tetraspanin 18
  ENST ID: ENST00000533080
  CDS Start-End: 425-840
ccccggtcccggccccgagccccgagcgagcgccgccgcctcgcgctgcgggtccccggacgcgccgccaccgccgggaaggcagccggcgccgggcaagttgcgagcgcgcccctccgaccaggaaagtttccccccggccgccggcgggatttggcgcggggtccggcagccgccgctggaagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaa

SEQ ID NO: 190374 - DNA, 726 bp, Homo sapiens
  Payload ID: 17608
  Gene Name: tetraspanin 18
  ENST ID: ENST00000533786
  CDS Start-End: 289-726
tttcttatctgcaagtcagaggagggtgagttccccaggctttcaacagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacagtgagt

SEQ ID NO: 190375 - DNA, 549 bp, Homo sapiens
  Payload ID: 17608
  Gene Name: tetraspanin 18
  ENST ID: ENST00000533202
  CDS Start-End: 311-549
aggcgaggggcagcccgcagaggagacgcgcttctcggcagcaacggcgtctggagccgggaggggcggagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaa

SEQ ID NO: 190376 - DNA, 651 bp, Homo sapiens
  Payload ID: 17609
  Gene Name: tetraspanin 19
  ENST ID: ENST00000433494
  CDS Start-End: 102-263
aaacaatctcgattctaaattgaaacgaacgcagcatttcagggactggatgaggagcttacggttttttacagaatcatcaatatcttggaagaaaaagaatgttaagaaataacaaaacaataattattaagtactttcttaatctcattaatggagctttcttggttcttggacttttattcatgggatttggtgcatggctcttattagatagaaataattttttaacagcttttggtggagtctcgctctgtcactaggctggagtgcagtggcacgatctcggctcactgcaacctccacctcccggattcaagcgattctcctgcctcagattccgaagtagctggaattacagtatgcagtattgataacatggacctttgctgttcaggttgtactttcagcattcatcatcacaaagaaagaggaggttcagcaactatggcatgacaaaattgattttgtcatttctgagtatggatctaaagataagcctgaagatataaccaagtggactattctgaatgccttacagaaaacatgttgtggccaacataattacacagactggataaagaataagaacaaagaaaattcaggacaggtgccatgttcttgcacaaagtcaactttaagaaaatggtt

SEQ ID NO: 190377 - DNA, 998 bp, Homo sapiens
  Payload ID: 17609
  Gene Name: tetraspanin 19
  Uniprot ID: P0C672
  ENST ID: ENST00000532498
  CDS Start-End: 82-828
tgaaacgaacgcagcatttcagggactggatgaggagcttacggttttttacagaatcatcaatatcttggaagaaaaagaatgttaagaaataacaaaacaataattattaagtactttcttaatctcattaatggagctttcttggttcttggacttttattcatgggatttggtgcatggctcttattagatagaaataattttttaacagcttttgatgaaaataatcacttcatagtacctatttctcaaattttgattggaatgggatcttctactgttcttttttgtctattgggttatataggaattcacaacgaaatcagatggctcctaattgtgtatgcagtattgataacatggacctttgctgttcaggttgtactttcagcattcatcatcacaaagaaagaggaggttcagcaactatggcatgacaaaattgattttgtcatttctgagtatggatctaaagataagcctgaagatataaccaagtggactattctgaatgccttacagaaaacattacagtgttgtggccaacataattacacagactggataaagaataagaacaaagaaaattcaggacaggtgccatgttcttgcacaaagtcaactttaagaaaatggttttgtgatgagccactgaatgcaacttaccttgagggttgtgaaaataaaatcagtgcatggtataatgttaatgtgttaaccttaatcggaattaactttggacttttaacttcagaggttttccaagtctcattaacagtttgtttcttcaaaaacatcaagaatataatccatgcagaaatgtgacctttggatttcaatttgttcagaagaaaccagttaattcttaaaaaatcacattatattattttattccaaaaacgttttgaattgtattaaataacagatgtattcaaattattaattatatgtaatattgaattactgaatactataataaaacattcatgaaatta

SEQ ID NO: 190378 - DNA, 385 bp, Homo sapiens
  Payload ID: 17609
  Gene Name: tetraspanin 19
  ENST ID: ENST00000525452
  CDS Start-End: 1-209
agtgttgtggccaacataattacacagactggataaagaataagaacaaagaaaattcaggacaggtgccatgttcttgcacaaagtcaactttaagaaaatggttttgtgatgagccactgaatgcaacttaccttgaggttttccaagtctcattaacagtttgtttcttcaaaaacatcaagaatataatccatgcagaaatgtgacctttggatttcaatttgttcagaagaaaccagttaattcttaaaaaatcacattatattattttattccaaaaacgttttgaattgtattaaataacagatgtattcaaattattaattatatgtaatattgaattactgaatactataataaaacattcatgaaattatattaa

SEQ ID NO: 190379 - DNA, 463 bp, Homo sapiens
  Payload ID: 17609
  Gene Name: tetraspanin 19
  ENST ID: ENST00000547836
  CDS Start-End: 200-463
gaacgcagcatttcagggactggatgaggagcttacggttttttacagagacagggtctccctctgttgcccaggctggagtgcagtggtacaattattgctcactgtagcctccaactcttgtactcaagtaatcctcccgccttggcctcccaaagcactgggattatagaatcatcaatatcttggaagaaaaagaatgttaagaaataacaaaacaataattattaagtactttcttaatctcattaatggagctttcttggttcttggacttttattcatgggatttggtgcatggctcttattagatagaaataattttttaacagcttttgatgaaaataatcacttcatagtacctatttctcaaattttgattggaatgggatcttctactgttcttttttgtctattgggttatataggaattcacaacgaaatcagatggctcctaattgtg

SEQ ID NO: 190380 - DNA, 687 bp, Homo sapiens
  Payload ID: 17609
  Gene Name: tetraspanin 19
  ENST ID: ENST00000552392
  CDS Start-End: 77-556
cgaacgcagcatttcagggactggatgaggagcttacggttttttacagaatcatcaatatcttggaagaaaaagaatgttaagaaataacaaaacaataattattaagtactttcttaatctcattaatggagctttcttggttcttggacttttattcatgggatttggtgcatggctcttattagatagaaataattttttaacagcttttgatgaaaataatcacttcatagtacctatttctcaaattttgattggaatgggatcttctactgttcttttttgtctattgggttatataggaattcacaacgaaatcagatggctcctaattgtggtggagtctcgctctgtcactaggctggagtgcagtggcacgatctcggctcactgcaacctccacctcccggattcaagcgattctcctgcctcagattccgaagtagctggaattacagtatgcagtattgataacatggacctttgctgttcaggttgtactttcagcattcatcatcacaaagaaagaggaggttcagcaactatggcatgacaaaattgattttgtcatttctgagtatggatctaaagataagcctgaagatataaccaagtggactattctgaatgccttacagaaaacattacagtgttgtggccaacataattacacagactggataa

SEQ ID NO: 190381 - DNA, 793 bp, Homo sapiens
  Payload ID: 17610
  Gene Name: tetraspanin 2
  ENST ID: ENST00000369515
  CDS Start-End: 69-659
ggagcctgccgctccccgcgctcgtagcgcgggcctggggactggggatcccgccgccgggccgcagcatggggcgcttccgcgggggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttggagccggggccctgatgatggccgtggggttcttcgggtgctgcggagccatgcgggagtcgcaatgtgtgcttggatcagctatccgacatgttcagaccatgtatgaagaggcttacaatgattaccttaaagacaggggaaaaggcaatgggacactcatcaccttccactcaacatttcagtgctgtggaaaagaaagctccgaacaggtccaacctacatgcccaaaggagcttctaggacacaagaattgcatcgatgaaattgagaccataatcagtgttaagctccagctcattggaattgtcggtattggaattgcaggtctgacgatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataatttgctgtcaattgtacatttgcatga

SEQ ID NO: 190382 - DNA, 3177 bp, Homo sapiens
  Payload ID: 17610
  Gene Name: tetraspanin 2
  Uniprot ID: O60636
  ENST ID: ENST00000369516
  CDS Start-End: 33-698
ggggactggggatcccgccgccgggccgcagcatggggcgcttccgcgggggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttggagccggggccctgatgatggccgtggggttcttcgggtgctgcggagccatgcgggagtcgcaatgtgtgcttggatcattttttacctgcctcctggtgatatttgctgctgaagtaaccactggagtatttgcttttataggcaagggggtagctatccgacatgttcagaccatgtatgaagaggcttacaatgattaccttaaagacaggggaaaaggcaatgggacactcatcaccttccactcaacatttcagtgctgtggaaaagaaagctccgaacaggtccaacctacatgcccaaaggagcttctaggacacaagaattgcatcgatgaaattgagaccataatcagtgttaagctccagctcattggaattgtcggtattggaattgcaggtctgacgatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataatttgctgtcaattgtacatttgcatgagtacgtatgtttggctcattactggtttaccccttgagtgaatgcctgtttatgatgactgagagcatattcatgtgtgatctgcgtgtttctggaatatgctttatacgtaatgaaatctgtttgctgggaattcctgattcttgttatataagaagaacaacctatttcgctcccagaaaaaaaagatcaaagagctttcagaaactttgagaacttggctatttagaaaaagtgataatgggtcagtttctcagactgtagccattgaaaattagatgcagagaattcagagatttcttcttaatggaagtaataagctgtaagaattgagagatcacaatggagtgttaaaactgactgtgtctaagttgggtgtaagggtttcctgggtttttttatatacatgctctccccagaatacagtaaaccacagttttagaactaaacacatctgtaaaactaaatatagcatggaaaatccaatttgaataagtcatgctttcctagaatttaaaaataaaaaagtcttcctctggaaagagaagtcacacagacaatcatgtgccctataaaagtgagtgtttataggactaaaaaacttttaacaactttttaaggaaatatttttgttcttatacaaaaacatgtaaatattgctttattactttcattttctgaccctgctgtaaactactgcaaccctcacatcctcaaagggacttttatgtcaaactcttctgtttctccaaatataaggaaaaaagactaaagcaagagatctggcagttgaaaattgtgggaaagagaatttgtatgggcactgtatctatgaaatacctcataacttacgtttacatgttttcctaactttttgtatttttcttgtatagccacctagagaattcttcatagattaagaactacagttttcaccacttaacataagtaaaacaaagtccttcataatttaaccattagcatctttggccaaaccaaaataaagaaaagcatcttctcctagttgtgtgtgggcaacagaaacaagttaaggaaacaaaaatacttatatatacacagaacaaaaataatgttctttttatgcaaatcccctgtgaaaataaaattttcaatgtttttttggtcttaacgcttcattttaacttagtaaacccaaatttaggatttacattggcaaatttttcagtgatttttaacgtgttacatttagtaaaccatagattttttaaaaactacattttgtaaggccacacataagtgaaaatacggaaggctttggaaacccccagatgaacttctatacatgtgaaaacacaagtctttgagtgtgcactaaaagtgtcacactcccaaaaaactcacaaaacattttgctaaaaagatatgactgcttgaaatagtctctctcccatggagaaccacatttctctttctgccatacttgctactgctactgattttggaggaaatttttctagaagaacaaaggtcatatttgaggcaagctaaaaacttaattatacatggctactttactgtgtctgtagctaaagaaaaattattttacaaaaattacttcatgaaatatagtttgtaccccagtagttgagaaatgtgaccttttaggcaaagaacaggcagtccatctctcttagctttagtttatctctctgcctgaagacaggaaacaggcccaagtgcatactcgggttctttccaactcagaatcatctctgattccacaaaagtgagtttagtttcctatctgaattaacaactttaaaggagactataatagttaaaagtggaagaatagaaataaataaatttaaaatgaaattaattaaagtagaagagaagggttctgttccatgtacgattaatgtgccccttttggagataagctttccaaaatatgcgtatgagtaaaattagagaattccaccactaagcaacaatagattttatatgtgtgtgtggatatatatacacacacacacagaaagatgaatatatatatatatatatctgtatagacacacatataatatatatagatatataatccctatatatcttgaatctacaaatatctttatatgtatataatttgaatatatacatgtatgtatatacagatgtgtgtgtatatatatatatacatacacatatacataaattttcagctatttctgttcccctgaactaatttgagattagacccaaacatgcttttaaatgtctcatgccaaggcactgaattaagacttcttaatgttgaaatattttaagtgatttcatattaaattttctatatactgaaa

SEQ ID NO: 190383 - DNA, 671 bp, Homo sapiens
  Payload ID: 17610
  Gene Name: tetraspanin 2
  ENST ID: ENST00000433172
  CDS Start-End: 1-564
ggcctgcggtgcatcaagtacctgctgcttggcttcaacctgctcttctggctggctggatcggccgtcattgcttttggactatggtttcggttcggaggtgccataaaggagttatcatcagaggacaagtccccagagtatttctatgtggggctgtatgttctggttggagccggggccctgatgatggccgtggggttcttcgggtgctgcggagccatgcgggagtcgcaatgtgtgcttggatcattttttacctgcctcctggtgatatttgctgctgaagtaaccactggagtatttgcttttataggcaagggggtagctatccgacatgttcagaccatgtatgaagaggcttacaatgattaccttaaagacaggggaaaaggcaatgggacactcatcaccttccactcaacatttcagtgctgtggaaaagaaagctccgaacaggtccaacctacatgcccaaaggagcttctaggacacaagatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataa

SEQ ID NO: 190384 - DNA, 6467 bp, Homo sapiens
  Payload ID: 17611
  Gene Name: tetraspanin 3
  Uniprot ID: O60637
  ENST ID: ENST00000267970
  CDS Start-End: 275-1036
ctgcagcctccgcagaggcgattggctgaagctaccggccgcgtggggcgggactcggttgccagggagcggcgcgggagccctgaggggactgcggcggctgcgcggaggagcgaggcacttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagtagtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaacatattatttttcattatttgggggatatttcagttccagagcagcagtatcatgttttctttgttggtgctgtctatagttcatcatggtttacgtgtgttttcgttatagctgttgccagattctaaagggcttgatattcaaaaaaccacagatgctttcagtccagtatatcctagaaatatagagctctactttgtgcaatgcactggggatacagtggcgatactgtccttgtcttcaaggagttcggagtcctagtataggagacatacataggagaagataattttcacactgcagtggttgtagtaatagaatgggagtccaaaggggagttccggagaggtcaggggtgacttcctggaggagatgcccaagcttggaggctggataggctttgttgaaagatggtacacaagagtgtgaaacaaaattgtgtgtgcagggagcttaaaatacaaggctggggaaagaagttggagaagcaggaaagcccaggccctctagtgtcttacggaacatcctgtggaggtgagagctgacttgtaggtggaagcagctctttggaggtttgatttggaaggtgaactgagaagaaggtggtgatgcaagccggccgtgctgaagccaggatgaattggtgtgactgggcttcagttaggctggcatagcagttgagagagcttagcagtgggcagcagggcactgttgggggcggtggtgagcggtggattctggctgtttggaggcaggacagtggtggaattcgatcattgattggacgtgggacagagaagggagaagagaagactcatctaggatgagtcccaggtttctggctcagtcaactggggaaacaaagtcacagagctagggagtagttagagaacacatctgggggtgtgactcatggtcagttttgggctcgtcagttttgagatgcccaaatatcatgcagatctgtcccacctgaaaatggagaagacacgggaaaggagaggagtaaaaactaactccttttcacaaagtggaagttaccagaatgtgatttcagaggccccgggggatttatcatgtgactactgacccatcccacctcttgcccctgcctgttgcacagtgggcaagaatgtttgtgacctttcactaccaccacctcccccgagcatggtccccccagttttcaatatgaaccatcctgtgggtaccctgtcacaggctggccctgaggtgagcaatatttggactgtgatgttggttgttctccactctttctacaggacagaacagggcctctagagtgggaaatggctttgggaaatatgccaagcagtagccttgttcttcaacttgcccaagaggataattctccacacccttcctgtactcagtcctcagtttgcctggtgagagagcagcctcctcccgtgtgctctgccagctggacccagactggccatattaccagtgagaccaaaaagatggaggtggggaggtagctctgaggtctgggaaaccattccagctcctgccagttttaacttgtgtttaattcctggcacagttgtcctggaaatgcctttttctcttgcctgggaaccactagaaggggatgttgtctgtgttggccagggccatgcaaattcaacatcttgtttctgcccttcccccgtgtagctgaggctaggtgttggcattacccagtgcttgttcttcagagagcaaaagcactgctcgtcatgtctgaaatttagtgagtgagctcacccactaggctggtgtttcctgcccgtggctgcacattggaagcaccggggcactttgagaactacagatgcctgggtcccagagcatctaaggtgctctagggtgtgtccaggacacagccctggttgaggaccactgctatattgtatggcctcttttaaaaaagttaattttacttggaaatgatttcaaagctacagaaaagttgcaagaataaaaactgtacaaatgaggctcaaatatcctttgcccagatacacctattaacatttcgtcccattctatctgtcatgtgtgttctcaaatgtgtgtgcgttctctctcccttgcgccaaccccctgtctctccctctccctccctcctgctgcctccacacctgtcatggccttttacccctaatacctcagtgggtacttaccaagaagaagatactctctgacgactgcagtacagttgtcaaattccgtccatctaacactgatagaatacctcaccactcatattcccattggccgcatcgtgtcctctatagcacctttccctctgcggtgctggatctggtctggatcaggtaatcagttgagttgtcatgtctccttggtcttctttaatctggatcatttccatagctttgtctgtgatgataggaacagtttgtaaggatacagttcgttttaggtggtgctgcttatctgtgtttgtctgcgatttcctcgtgattagatttggttttgcattccaggtggctgaaccactacctgcgtcacgcggcctctcagggcatcgcatctcgaggcacacaatgcccatctgccccacagtggggatgttcgttttgatcatctagtccaaggaggaggaaatgtgaacaggaaggttttaatataagtaattgttaactgtgtagaaggtagttaactactaaaagggataaaaaagagctctaaagcagcttagcagagaacagccatcacccctagggctaagggaagagaaaacagagaaggaacgtggaaactcagaggaggttccccaaggtggagagacctccgaggggtggctgtggttgcctgggatatgctgcctgtcccatgctggagaatcaacttactggaggtgcccccccgccaagccacaggagcagagagctgtcacggtggggaatgctgctgggacccgtgcaggacgaaaggagacagaagaaaaaggccatcttcctcctctagccttgttagccccttcagagcccactgtgggtcaggctggcaaagggtaaaggagttttcagagccccctcttcagtgtgacaaggaagggcaaggtcagggaaatttggagttaagaggcaataaatgagtacctggcacacctagtcgaggtgtgtccactttctccatagcatggttactgtttttttcttttcaactaataagaaatctctggagacacactgtctccatgtacataccctgttcctcatgagactcttccccattccccgaccaggttcagcaaatgttgctgattctggcctgattcaatctttatgatgactgccaagcgacgtttctgcagcccagcactccttcctcatttgccagtcatccctcccttctccttcatttattttcatatatccactatggattcccattttttcaaaagtcgacttcatcattgacctttggggatgggggaagagttcctcagatagttcccgacttggccagcgagagccccttcgagtgcctcctatatcccagcatttttggaagcactcccctaatttctgatctaacaagatgttccaggcccctgggcaccagccatggatcagtgtttgtcccaggagccctggtccctggcactaggtgtgcttattgcagctggggtgtctttgcttcttgtcctatagatgattgacagagcttgtcttactgccttttttaagtgtatttttttaaacaaaagtaattggtgctttaaaaaatgtgaacaatacagacatctgtaaagaagtacccacagggaagcaagttcagcagttcagcaatggcatgtgtctttgcagactacatacacagaaacagacttggtattgggttttggtttttgctttttgctaataggaattttatcctacaagatcctctttctgtcttcacaacatagtctgatgctccttccatgtctaactgtaggatttgtcattccattgtgttagctgtgtgggtacattagtaccatgattaaccaaggtgtataaagggcaggcctgcaggctgcctccagtgcctccactactcgccacagtgatcatctctatacacacactgcagtcatttacaatttttaaaatgaaaacaatttttattgagatgcaattcacatggcataaaattaacgattttaaagtaaagaagttgccttgagtacattcaccatgctatagaaccactgcctgtatctagtttcaaagcactttcatcaccctgtgtcatgtatttttacatgaactccaagggtggattcttgttagttggatttactctggatggaaaagtcatgtttggctgggtgcagtggctcatgcctgtaatcatagcactttgggaggtcgagacaggtgggtcacttgagatcaggagttcaaaaccagcctggccaacatggtgaaacccatctctattaaaaatacaaaaaattagcagggcctggtggcatgcacctgtaatcccagctacttgggaggctgaggcaggagaatcgcttgaaccgggaggcagaggttgcagtgagccgagattatgccactgcactccagcctgggtgacagagcaagactctgtctc

SEQ ID NO: 190385 - DNA, 1647 bp, Homo sapiens
  Payload ID: 17611
  Gene Name: tetraspanin 3
  Uniprot ID: O60637
  ENST ID: ENST00000346495
  CDS Start-End: 156-842
acttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagtagtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagccccc

SEQ ID NO: 190386 - DNA, 1530 bp, Homo sapiens
  Payload ID: 17611
  Gene Name: tetraspanin 3
  Uniprot ID: O60637
  ENST ID: ENST00000424443
  CDS Start-End: 156-725
acttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctggtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagtagtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagccccc

SEQ ID NO: 190387 - DNA, 1326 bp, Homo sapiens
  Payload ID: 17611
  Gene Name: tetraspanin 3
  ENST ID: ENST00000559494
  CDS Start-End: 81-575
ggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctgggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagtagtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatg

SEQ ID NO: 190388 - DNA, 1592 bp, Homo sapiens
  Payload ID: 17611
  Gene Name: tetraspanin 3
  ENST ID: ENST00000561277
  CDS Start-End: 680-817
ggaggagcgaggcacttgctggggtcggggctgcgcgacggcgcaggggctgcggggagcgccgcgcaggccgtgcagttcctagcgaggaggcgccgccgccattgccgctctctcgggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagtagtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaa

SEQ ID NO: 190389 - DNA, 1340 bp, Homo sapiens
  Payload ID: 17611
  Gene Name: tetraspanin 3
  ENST ID: ENST00000558745
  CDS Start-End: 700-837
gactgggtaggtggcaagcctgagtgatcggagagaagccgggacggatgcaaatgcagagcccgctggcagaggcgcagaggcaccgaccgaccgaccaaccggagcgaggaggcccccagagacagccgccgccctggggcagctggcattttatgctatgtgggagcctatgtcttcatcacttatgatgactatgaccacttctttgaagatgtgtacacgctcatccctgctgtagtgatcatagctgtaggagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataagacctacaatggaaccaaccctgatgctgctagccgggctattgattatgtacagagacagctgcattgttgtggaattcacaactactcagactgggaaaatacagattggttcaaagaaaccaaaaaccagagtgtccctcttagctgctgcagagagactgccagcaattgtaatggcagcctggcccacccttccgacctctatgctgaggggtgtgaggctctagtagtgaagaagctacaagaaatcatgatgcatgtgatctgggccgcactggcatttgcagctattcagctgctgggcatgctgtgtgcttgcatcgtgttgtgcagaaggagtagagatcctgcttacgagctcctcatcactggcggaacctatgcatagttgacaactcaagcctgagctttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtac

SEQ ID NO: 190390 - DNA, 1849 bp, Homo sapiens
  Payload ID: 17612
  Gene Name: tetraspanin 31
  Uniprot ID: Q12999
  ENST ID: ENST00000257910
  CDS Start-End: 275-907
agttttaagtttcgcccaatgaaaaaacaaaaggagagggacagaaggcgggtcggtgacgtaatgcgggttgattggcatgcaggccttggacgtccaggattagccacgcatttcgccaatccagaggcaggggagggacggtgcaggcgcagagtattgggtttggctggcctcgatttaaagagacagaagctgtcggggtcctggaagacggtccccaataccctccccccaagtccttgggaccacttgggtccccagagctggggagatggtttgtggcggctttgcctgctccaagaatgcgctttgcgctctcaacgtggtctacatgctggtgagcttgttgctcattggagtggctgcttggggcaagggcctgggtctggtgtccagcatccacatcatcggcggagtcattgctgtgggagtcttccttctccttattgcagtggctggactggtgggtgctgtcaaccaccaccaagtcctgctgttcttttacatgatcatccttggtttggtcttcatcttccaatttgtaatctcttgctcatgtctggctattaaccgaagcaaacagacagatgtcatcaatgcttcttggtgggtcatgagcaacaagactcgggatgaactggaaagaagttttgattgttgtggcttattcaacctcacaaccctgtatcaacaagattatgatttctgcactgcaatctgcaagagccagagccccacatgccagatgtgtggagaaaagtttcttaagcattcagacgaagccctgaaaatcctagggggtgttggactcttctttagctttacagagatccttggtgtttggctagcaatgagatttcggaatcagaaggatcctagagccaaccccagtgcctttctatgagactttggatccttctgacttttcttctgctctctctaagctttctcttcctcccttagggaatatctagggtctgtaaccgttttggtttgagaaaaaggaaaggccccttgtcacatcctctaaaattgatggaatagcaagactttatgccttgacatattttagtgggagccagactataaggaataaaaggaaaaactttcttcctctctctccaagaggatatgggaagcttctgtgagtgcataggatgggggctggagtcattcttagctgtttcccttcctctgtccatatactggatcacctcaacataccctggtgtggctctaagggtaaatcagggatagggccaaggagaaaacaaccaagaactctttcctgtaataagcaggatccagtttgagaaagtttagcgaatataaaagtaaaagccatttaaaaatctatattctttttttttttttgacacagagtcttgctctgttgcccaggctggagtgcaatggcatgatctcggctcaccgcaacctctgcctcccgggttcaagcgatcctcctgcctcagtctcccaagtagctgggattacaggtgtgcaccaccacgcctgactaattttgtatttttagtagagacagggtttcaccatgttagtcaggctggtctcgaactcctgacctcaggtgatccacccgcgttggcctcccaacgtgctgggattataggcgtgagccaccacgccccgcctaaaatccatattcaaagaagcaatttcagttcctttctaagctttgtcagtcaaggggctccactgacttcctaggccctgtaatttaaccagtctttaaggttttgcaggaaagtcccttcttccaagtggtttttccaaatcgcacaatggcaaagccaaacagaggaagaaacattaaaaaaaaaaa

SEQ ID NO: 190391 - DNA, 820 bp, Homo sapiens
  Payload ID: 17612
  Gene Name: tetraspanin 31
  ENST ID: ENST00000553089
  CDS Start-End: 117-503
attgggtttggctggcctcgatttaaagagacagaagctgtcggggtcctggaagacggtccccaataccctccccccaagtccttgggaccacttgggtccccagagctggggagatggtttgtggcggctttgcctgctccaagaatgcgctttgcgctctcaacgtggtctacatgctggtgagcttgttgctcattggagtggctgcttggggcaagggcctgggtctggtgtccagcatccacatcatcggcggagtcattgctgtgggagtcttccttctccttattgcagtggctggactggtgggtgctgtcaaccaccaccaagtcctgctgttcttttacatgatcatccttggtttggtcttcatcttccaatttgtaatctcttgctcatgtctggctattaaccgaagcaaacagatcatccttaggtgcactgcttctggcctcttgggctatttgcttcctctgggatgtctggttaattttccatgaggatgatctagagaacctcaaaagacagatgtcatcaatgcttcttggtgggtcatgagcaacaagactcgggatgaactggaaagaagttttgattgttgtggcttattcaacctcacaaccctgtatcaacaagattatgatttctgcactgcaatctgcaagagccagagccccacatgccagatgtgtggagaaaagtttcttaagcattcagacgaagccctgaaaatcctagggggtgttggactcttctttagctttacagaggtaacattctccagttccctcacacacatcctttttgagactgagaa

SEQ ID NO: 190392 - DNA, 3434 bp, Homo sapiens
  Payload ID: 17612
  Gene Name: tetraspanin 31
  ENST ID: ENST00000547992
  CDS Start-End: 133-513
ggtgcaggcgcagagtattgggtttggctggcctcgatttaaagagacagaagctgtcggggtcctggaagacggtccccaataccctccccccaagtccttgggaccacttgggtccccagagctggggagatggtttgtggcggctttgcctgctccaagaatgcgctttgcgctctcaacgtggtctacatgctggtgagcttgttgctcattggagtggctgcttggggcaagggcctgggtctggtgtccagcatccacatcatcggcggagtcattgctgtgggagtcttccttctccttattgcagtggctggactgatctgcaagagccagagccccacatgccagatgtgtggagaaaagtttcttaagcattcagacgaagccctgaaaatcctagggggtgttggactcttctttagctttacagagatccttggtgtttggctagcaatgagatttcggaatcagaaggatcctagagccaaccccagtgcctttctatgagactttggatccttctgacttttcttctgctctctctaagctttctcttcctcccttagggaatatctagggtctgtaaccgttttggtttgagaaaaaggaaaggccccttgtcacatcctctaaaattgatggaatagcaagactttatgccttgacatattttagtgggagccagactataaggaataaaaggaaaaactttcttcctctctctccaagaggatatgggaagcttctgtgagtgcataggatgggggctggagtcattcttagctgtttcccttcctctgtccatatactggatcacctcaacataccctggtgtggctctaagggtaaatcagggatagggccaaggagaaaacaaccaagaactctttcctgtaataagcaggatccagtttgagaaagtttagcgaatataaaagtaaaagccatttaaaaatctatattctttttttttttttgacacagagtcttgctctgttgcccaggctggagtgcaatggcatgatctcggctcaccgcaacctctgcctcccgggttcaagcgatcctcctgcctcagtctcccaagtagctgggattacaggtgtgcaccaccacgcctgactaattttgtatttttagtagagacagggtttcaccatgttagtcaggctggtctcgaactcctgacctcaggtgatccacccgcgttggcctcccaacgtgctgggattataggcgtgagccaccacgccccgcctaaaatccatattcaaagaagcaatttcagttcctttctaagctttgtcagtcaaggggctccactgacttcctaggccctgtaatttaaccagtctttaaggttttgcaggaaagtcccttcttccaagtggtttttccaaatcgcacaatggcaaagccaaacagaggaagaaacattaaaaaaaaaaaaaagaccattatttctttgttttgtttttcctgtataaaaaaggaccccaaatataaaggtagggaaagggacaagagggaacataccccttagtgtagagaaatgggaaggagaaggagaagcctcaaaaggagaggtgggaggggaatgtcattaaggcagcaaagtaatctctgtagaaagatggaggaggaccctccatagcctcagagataaaggcaaagattgccctctcagtgtccagaagggaaatggcagcttttcttccttccatggcagccactccattgctcactccggattaccttcatccttatgtagataagagtgctgcagagctcgaaaggcagagattcgcttgtgtgggttaaaagtcagcatttcctgaggggagaggcaaaggtcagaaaaccatgaagaaaacagacttctgcccacccacaacaatacctgggatgagctttcttcttttttctttttttttttttttgagacggagtctcgctctatcacccaggctggagtgcaatggtatgatctcagctcactgcaacctccgcctcctgagttgaagtgattctcctatctcagcctcccaagtagctgagattacaggcgtgtgccaccacccccggcttatttttgtacttttagtagagacgaggtttcaccatgttggccaggctggtctcgaactcctgacctcaggtgatacgcccaccttggcctcccaaagtgctgggattacaggcgtgagccaccgtgcccagccaggatgggttctcttctatatccttctctgtgggtggctatttgcagctgtaataaaaactacagcccatctaccaaccaagtttcattaaccacagtggccagggccctgcatactgctctatttctttccccagtctctatttctttccctgtgcccacagccatctccagtaccagcagcagctgtgctcccgactcctccatctcaggtaccaccgactgcactgggcggggccctctggggggaaaggctccacggggcagggatacatctcgaggccagtcatcctctggaggcagcccaatcaggctgtgggggacaggagaactctggtcaggagggtcctccagttcccatccccatgggcagagccagttgccatcctgggttcagcagaaagaggactcagaatagaaaatctttttctcccatgttggtcacttactcaaagattttgcccaactggtcggcttcagagtttccacagaagagaggcctaaggtgagaagggatataaggtagcagtcattttcaaagatatcttagttgaatggttactgcttagtggctcaaaataggaagtatagggaataaaggccaacaattccagcactttgggatgctgaggtgagaggactgcttgagcccaggagttctagatcagcctgggcaagcaagaccttgtctctttttttaaaaaaaaagaaatgccaggtgcagcggctcacgcctgtaatcctagcactttgggagtctgatgtgggtggatcatgaggtcaagagatcgagaccatcctggccaacatggtgaaaccctgtcattactaaaagtacaaaaattagctgagcatggtggcgtgcacctgtggtcccagctacttgggaggctgagtcaagagaattgcttgaatctgggaggtggaggttgcagtgagcagagatcgcactactgcactccagcctggcgacagagcaagactccatctaaaaaaaaaaaaagccagtcatggtggcgtgcacctgtagtctcagctactcaagaggctgagatgggaggattgctttagcccaggaggtagaggctacagtgagctgtaattgggccactgcactccagcctgggtgacagagtgaaaccttatctcaataaataaataaataaataaataaataaataaataaataaataaaaaataaagagaa

SEQ ID NO: 190393 - DNA, 488 bp, Homo sapiens
  Payload ID: 17612
  Gene Name: tetraspanin 31
  ENST ID: ENST00000548167
  CDS Start-End: 230-488
ttccggttgattaagggggtttgtctgagggtgggggaatgaactgaaggccgtgggcctggtgagcttgttgctcattggagtggctgcttggggcaagggcctgggtctggtgtccagcatccacatcatcggcggagtcattgctgtgggagtcttccttctccttattgcagtggctggactggtgggtgctgtcaaccaccaccaagtcctgctgttcttttacatgatcatccttggtttggtcttcatcttccaatttgtaatctcttgctcatgtctggctattaaccgaagcaaacagacagatgtcatcaatgcttcttggtgggtcatgagcaacaagactcgggatgaactggaaagaagttttgattgttgtggcttattcaacctcacaaccctgtatcaacaagattatgatttctgcactgcaatctgcaagagccagagccccacatgccagatgtgtggagaaaagtttc

SEQ ID NO: 190394 - DNA, 475 bp, Homo sapiens
  Payload ID: 17612
  Gene Name: tetraspanin 31
  ENST ID: ENST00000547472
  CDS Start-End: 90-473
gagacagaagctgtcggggtcctggaagacggtccccaataccctccccccaagtccttgggaccacttgggtccccagagctggggagatggtttgtggcggctttgcctgctccaagaatgcgctttgcgctctcaacgtggtctacatgacagatgtcatcaatgcttcttggtgggtcatgagcaacaagactcgggatgaactggaaagaagttttgattgttgtggcttattcaacctcacaaccctgtatcaacaagattatgatttctgcactgcaatctgcaagagccagagccccacatgccagatgtgtggagaaaagtttcttaagcattcagacgaagccctgaaaatcctagggggtgttggactcttctttagctttacagagatccttggtgtttggctagcaatgagatttcggaatcagaaggatcctagagccaaccccagtgcctttctatgaga

SEQ ID NO: 190395 - DNA, 582 bp, Homo sapiens
  Payload ID: 17612
  Gene Name: tetraspanin 31
  ENST ID: ENST00000552816
  CDS Start-End: 365-582
attgggtttggctggcctcgatttaaagagacagaagctgtcggggtcctggaagacggtccccaataccctccccccaagtccttgggaccacttgggtccccagagctggggagatggtttgtggcggctttgcctgctccaagaatgcgctttgcgctctcaacgtggtctacatggtgaggttttggagctggtgagcttgttgctcattggagtggctgcttggggcaagggcctgggtctggtgtccagcatccacatcatcggcggagtcattgctgtgggagtcttccttctccttattgcagtggctggactggtgggtgctgtcaaccaccaccaagtcctgctgttcttttacatgatcatccttggtttggtcttcatcttccaatttgtaatctcttgctcatgtctggctattaaccgaagcaaacagacagatgtcatcaatgcttcttggtgggtcatgagcaacaagactcgggatgaactggaaagaagttttgattgttgtggcttattcaacctcacaaccctgtatcaacaagattatgatttctgcactgcaatctgcaa

SEQ ID NO: 190396 - DNA, 1100 bp, Homo sapiens
  Payload ID: 17612
  Gene Name: tetraspanin 31
  ENST ID: ENST00000549052
  CDS Start-End: 106-447
ctggcctcgatttaaagagacagaagctgtcggggtcctggaagacggtccccaataccctccccccaagtccttgggaccacttgggtccccagagctggggagatggtttgtggcggctttgcctgctccaagaatgcgctttgcgctctcaacgtggtctacatgctggtgagcttgttgctcattggagtggctgcttggggcaagggcctgggtctggtgtccagcatccacatcatcggcggagtcattgctgtgggagtcttccttctccttattgcagtggctggactggtgggtgctgtcaaccaccaccaagtcctgctgttcttttacatgatcatccttggtttggtcttcatcttccaatttgtaatctcttgctcatgtctggctattaaccgaagcaaacagatgtcatcaatgcttcttggtgggtcatgagcaacaagactcgggatgaactggaaagaagttttgattgttgtggcttattcaacctcacaaccctgtatcaacaagattatgatttctgcactgcaatctgcaagagccagagccccacatgccagatgtgtggagaaaagtttcttaagcattcagacgaagccctgaaaatcctagggggtgttggactcttctttagctttacagagatccttggtgtttggctagcaatgagatttcggaatcagaaggatcctagagccaaccccagtgcctttctatgagactttggatccttctgacttttcttctgctctctctaagctttctcttcctcccttagggaatatctagggtctgtaaccgttttggtttgagaaaaaggaaaggccccttgtcacatcctctaaaattgatggaatagcaagactttatgccttgacatattttagtgggagccagactataaggaataaaaggaaaaactttcttcctctctctccaagaggatatgggaagcttctgtgagtgcataggatgggggctggagtcattcttagctgtttcccttcctctgtccatatactggatcacctcaacataccctggtgtggctctaagggtaaatcagggatagggccaaggagaaa

SEQ ID NO: 190397 - DNA, 1318 bp, Homo sapiens
  Payload ID: 17613
  Gene Name: tetraspanin 32
  Uniprot ID: Q96QS1
  ENST ID: ENST00000182290
  CDS Start-End: 138-1100
agggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttgctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaaggtacgtcccacgtccggcggcaggagctggcggccatccaggacgtgtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacggtgtccgccttgctcttcagctccttcctgtggtttgccatccgctgtggctgcagcttggaccgcaagggcaaatacaccctgaccccacgagcatgtggccgccagccccaggagcccagcctcttgagatgctcccagggtggacccacacattgtctccactccgaagcagttgctattggtccaagaggatgctcgggtagtcttcggtggctgcaggagagcgatgctgcgcctctgcccctctcctgccacctggctgcccacagagctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaa

SEQ ID NO: 190398 - DNA, 1202 bp, Homo sapiens
  Payload ID: 17613
  Gene Name: tetraspanin 32
  ENST ID: ENST00000339046
  CDS Start-End: 104-535
cgggaatccctgcagctgagcctgtctctcacgggaccgggaagctggagagagccccaaccctgcccgctggggccgagctccctgctcctgcagcagtcccatgccccacactctgagtctgccctatccacagctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaagtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacggtgtccgccttgctcttcagctccttcctgtggtttgccatccgctgtggctgcagcttggaccgcaagggcaaatacaccctgaccccacgcatgtggccgccagccccaggagcccagcctcttgagatgctcccagggtggacccacacattgtctccactccgaagcagttgctattggtccaagaggatgctcgggtagtcttcggtggctgcaggagagcgatgctgcgcctctgcccctctcctgccacctggctgcccacagagctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaa

SEQ ID NO: 190399 - DNA, 798 bp, Homo sapiens
  Payload ID: 17613
  Gene Name: tetraspanin 32
  ENST ID: ENST00000381117
  CDS Start-End: 1-798
atggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcaggggtggaggacgccatgctggacacctacgacctggtatatgagcaggcgatgaaaggtacgtcccacgtccggcggcaggagctggcggccatccaggacgtgtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacggtgtccgccttgctcttcagctccttcctgtggtttgccatccgctgtggctgcagcttggaccgcaagggcaaatacaccctgaccccacgagcatgtggccgccagccccaggagcccagcctcttgagatgctcccagggtggacccacacattgtctccactccgaagcagttgctattggtccaagaggatgctcgggtagtcttcggtggctgcaggagagcgatgctgcgcctctgcccctctcctgccacctggctgcccacagagctctccagggcagaagtcgcggtgggctcagtgggtgccctgagcggggtctctcagactga

SEQ ID NO: 190400 - DNA, 999 bp, Homo sapiens
  Payload ID: 17613
  Gene Name: tetraspanin 32
  Uniprot ID: Q96QS1
  ENST ID: ENST00000381121
  CDS Start-End: 1-762
atggggccttggagtcgagtcagggttgccaaatgccagatgctggtcacctgcttctttatcttgctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaaggtacgtcccacgtccggcggcaggagctggcggccatccaggacgtgtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacggtgtccgccttgctcttcagctccttcctgtggtttgccatccgctgtggctgcagcttggaccgcaagggcaaatacaccctgaccccacgctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaa

SEQ ID NO: 190401 - DNA, 1262 bp, Homo sapiens
  Payload ID: 17613
  Gene Name: tetraspanin 32
  Uniprot ID: Q96QS1
  ENST ID: ENST00000446063
  CDS Start-End: 138-914
agggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttgctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaaggtacgtcccacgtccggcggcaggagctggcggccatccaggacgtgtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacgcttggaccgcaagggcaaatacaccctgaccccacgagcatgtggccgccagccccaggagcccagcctcttgagatgctcccagggtggacccacacattgtctccactccgaagcagttgctattggtccaagaggatgctcgggtagtcttcggtggctgcaggagagcgatgctgcgcctctgcccctctcctgccacctggctgcccacagagctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaa

SEQ ID NO: 190402 - DNA, 734 bp, Homo sapiens
  Payload ID: 17613
  Gene Name: tetraspanin 32
  ENST ID: ENST00000437313
  CDS Start-End: 154-567
ccagcagctcggtcctagggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttggtaacagctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccagcacccatccttccgtcctggatgctgacctgcctggaggagggtccggcctagctgaccgtgggcaggggccaagggcgtccccgtggaaaggccagcagcttggagaggaaggaggcctccctggcccagcagagaatgagagctcggtagcagagccagccccaccttccccttgagagccagacctggcccagaaggatcccagaggggctgagccc

SEQ ID NO: 190403 - DNA, 1236 bp, Homo sapiens
  Payload ID: 17613
  Gene Name: tetraspanin 32
  ENST ID: ENST00000451520
  CDS Start-End: 89-1018
ctgagcctgtctctcacgggaccgggaagctggagagagccccaaccctgcccgctggggccgagctccctgctcctgcagcagtcccatgccccacactctgagtctgccctatccacagctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaaggtacgtcccacgtccggcggcaggagctggcggccatccaggacgtgtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacggtgtccgccttgctcttcagctccttcctgtggtttgccatccgctgtggctgcagcttggaccgcaagggcaaatacaccctgaccccacgagcatgtggccgccagccccaggagcccagcctcttgagatgctcccagggtggacccacacattgtctccactccgaagcagttgctattggtccaagaggatgctcgggtagtcttcggtggctgcaggagagcgatgctgcgcctctgcccctctcctgccacctggctgcccacagagctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaa

SEQ ID NO: 190404 - DNA, 1301 bp, Homo sapiens
  Payload ID: 17613
  Gene Name: tetraspanin 32
  ENST ID: ENST00000612299
  CDS Start-End: 228-1025
agggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttgctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcaggggtggaggacgccatgctggacacctacgacctggtatatgagcaggcgatgaaaggtacgtcccacgtccggcggcaggagctggcggccatccaggacgtgtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacggtgtccgccttgctcttcagctccttcctgtggtttgccatccgctgtggctgcagcttggaccgcaagggcaaatacaccctgaccccacgagcatgtggccgccagccccaggagcccagcctcttgagatgctcccagggtggacccacacattgtctccactccgaagcagttgctattggtccaagaggatgctcgggtagtcttcggtggctgcaggagagcgatgctgcgcctctgcccctctcctgccacctggctgcccacagagctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaaccattgttaagtgtatggtttgtggcattaaatacattcacattgttgtgcaaccatc

SEQ ID NO: 190405 - DNA, 1863 bp, Homo sapiens
  Payload ID: 17614
  Gene Name: tetraspanin 33
  Uniprot ID: Q86UF1
  ENST ID: ENST00000486685
  CDS Start-End: 90-941
ctcggctcatgcccccgggcgcggggcacacaggccggccggcagccgctgggaaataggcccccgggggcggtggcggcggcggggccatggcgcggagaccccgggcgccggccgcctccggggaggagttctccttcgtcagcccgctggtgaaatacctgctcttcttcttcaacatgctcttctgggtgatttccatggtgatggtggctgtgggtgtctacgctcggctaatgaagcatgcagaagcagccctagcctgcctggcagtggaccctgccatcctgctgatcgtggtgggtgtcctcatgttcctgctcaccttctgtggctgcattgggtccctccgcgagaacatctgcctcctgcagacgttctccctctgcctcaccgctgtgttcctgctgcagctggccgctgggatcctgggcttcgtcttctcagacaaggctcgagggaaagtgagtgagatcatcaacaatgccattgtgcactaccgagatgacttggatctgcagaacctcattgattttggccagaaaaagtttagctgctgtggagggatttcctacaaggactggtctcagaacatgtatttcaactgctcagaagacaaccccagtcgagagcgctgctctgtgccttactcctgttgcttgcctactcctgaccaggcagtgatcaacactatgtgtggccaaggtatgcaggcctttgactacttggaagctagcaaagtcatctacaccaatggctgtattgacaagttggtcaactggatacacagcaacctattcttacttggtggtgtggctctaggcctggccatcccccagctggtgggaattctgctgtcccagatcctagtgaatcagatcaaagatcagatcaagctacagctctacaaccagcagcaccgggctgacccatggtactgagaatccatcctgcacctcctcaccatggaaactggcaagcctcataaacgaacagcagtgggtgctgaaagcagcaccaaatggagatttggattccagccccccagtgacagcccagtgggaagaagcaaactccagatgggcagaaggcagggtgcacaggtggctccagtctcaggaggatgcgcctcctctcccccatcccagccctcagcattgtgccagagtgatacccttaagtgtttgggtttatgttttcagttttgtttgggaaacagcagttgcacagagagttgggggtactgctgctgccttttcaccgaggcactgccaccaccagctctagcagggatgctcctgagcttggcggacatacttagatcctaacgtgccagtgagacctggctgtggagagtagcactggcagccctgcctggactccacttggcatgataccagctccagaagggaagggagtggagcaggcagtgaggagagagcctgggggtcggctggggacagccgtatgtgctaggtaggagtggagggagatatgtttaccaaatgcctgtcctgccatcctcccaggtagtcagagtgagctacatcctgccccgccttcatttccatggaaacatggcagctaggacacggggtacaacagcagccaaattcttccccacctcccttacttcgaaaaaaagtttggaaccctggtccctatactctgcagtcagaagtgggactgagccatacatgcccttgaattcctccctgtctggccctccctctccagcaagcagggttttctttaacttggcagtgtgcagaggagaagtggtaacacccccaccccattcccctgcatcggagctcagtattcctacagggtaagaggtaggaatcttgctgggacgagggg

SEQ ID NO: 190406 - DNA, 882 bp, Homo sapiens
  Payload ID: 17615
  Gene Name: tetraspanin 4
  ENST ID: ENST00000346501
  CDS Start-End: 122-736
gcagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccc

SEQ ID NO: 190407 - DNA, 1332 bp, Homo sapiens
  Payload ID: 17615
  Gene Name: tetraspanin 4
  ENST ID: ENST00000397396
  CDS Start-End: 322-846
aaagctgcggcggcggttcgcgtttctcgtgtccgcttgactgacagctgcgcggcgggagcgggcggcgcgagcgggaggcggcggcgcagagcttggggcttccttggtcgcacccaccacctgcctgcccactggtcagccttcagggaccctgagcaccgcctggtctctttcctgtggccagcccagctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaaccttg

SEQ ID NO: 190408 - DNA, 1423 bp, Homo sapiens
  Payload ID: 17615
  Gene Name: tetraspanin 4
  Uniprot ID: O14817
  ENST ID: ENST00000397397
  CDS Start-End: 226-942
gtctgagcagggccgtaaagctgcggcggcggttcgcgtttctcgtgtccgcttgactgacagctgcgcggcgggagcgggcggcgcgagcgggaggcggcggcgcagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 190409 - DNA, 1462 bp, Homo sapiens
  Payload ID: 17615
  Gene Name: tetraspanin 4
  Uniprot ID: O14817
  ENST ID: ENST00000397404
  CDS Start-End: 260-976
actgccccagcctcaggctctgtgcatctcccccgagcccccaccacatatgtgcggaggcccctgggggcccaggcctgtcctcagtcccgactgggctctacctgaggaccctggggagcctgggcctggccctcctcagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaaccttg

SEQ ID NO: 190410 - DNA, 1426 bp, Homo sapiens
  Payload ID: 17615
  Gene Name: tetraspanin 4
  Uniprot ID: O14817
  ENST ID: ENST00000397406
  CDS Start-End: 224-940
tggacgcacatcctgctctgggcagaagggcaggacaggggccctgagtaacggtggcctggggtcagagccaggttcagctgcgaggctgctggtggctgtggagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaaccttg

SEQ ID NO: 190411 - DNA, 1430 bp, Homo sapiens
  Payload ID: 17615
  Gene Name: tetraspanin 4
  Uniprot ID: O14817
  ENST ID: ENST00000397408
  CDS Start-End: 228-944
cgtgcggccagggtcccgtggccggaggtgtccgaccgggagcggctggagccggacgcgagcggggcgcgcgagttcgagcccagagccgacacgcagcaacaagtgggagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaaccttg

SEQ ID NO: 190412 - DNA, 1025 bp, Homo sapiens
  Payload ID: 17615
  Gene Name: tetraspanin 4
  Uniprot ID: O14817
  ENST ID: ENST00000397411
  CDS Start-End: 122-838
gagcagggccgtaaagctgcggcggcggttcgcgtttctcgtgtccgcttgactgacagctgcgcggcgggagcgggcggcgcgagcgggaggcggcggcgcagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctcc

SEQ ID NO: 190413 - DNA, 1031 bp, Homo sapiens
  Payload ID: 17615
  Gene Name: tetraspanin 4
  Uniprot ID: O14817
  ENST ID: ENST00000409543
  CDS Start-End: 88-804
aggggccctgagtaacggtggcctggggtcagagccaggttcagctgcgaggctgctggtggctgtggagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcgga

SEQ ID NO: 190414 - DNA, 1339 bp, Homo sapiens
  Payload ID: 17615
  Gene Name: tetraspanin 4
  ENST ID: ENST00000409531
  CDS Start-End: 85-858
agaggcgtggggtaggctgcagggcacagctgggggcctctgtccccatctccggctgtgggaggtgtgtgcgcatccggcgtgatgacacccaggagtgcaggcacatctgcgcacggggccgaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggagatggccgcacccacagctgcctttcccaccaccagcctcggtgctctgccccatgctgggaggagggagggagggacaggtgcctggagcccccggaaccctgtttctggaaggccctagctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtggcccccagcctcctggaaaacaggttggcgctggaggagccgggtcttggcatcctggaggtggccccactggtcctggtgctccaggcggggccgtggacccctcacctacattccatagtgggcccgtggggctcctggtgcatcttaataaagtgtgagcagcaa

SEQ ID NO: 190415 - DNA, 834 bp, Homo sapiens
  Payload ID: 17615
  Gene Name: tetraspanin 4
  ENST ID: ENST00000525201
  CDS Start-End: 264-788
aggttcagctgcgaggctgctggtggctgtggagagcttggggcttccttggtcgcacccaccacctgcctgcccactggtcagccttcagggaccctgagcaccgcctggtctctttcctgtggccagcccagctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgtggcttcaggagaacctgctggctgtgggcatctttgggctgtgcacggcgctggtgcagatcctgggcctgaccttcgccatgaccatgtactgccaagtggtcaaggcagacacctactgcgcgtaggccgcccaccgcccgcttctctgccaaaaggacgcccacggggaga

SEQ ID NO: 190416 - DNA, 860 bp, Homo sapiens
  Payload ID: 17615
  Gene Name: tetraspanin 4
  ENST ID: ENST00000525334
  CDS Start-End: 561-860
tcccgggtcccggctctgctggctgctcgccgtcccgagctcccgacgctcagacgcgcctctgagcacggggagaggggacccgggagggaggtcggggagggagtcgtggaagaggtgctttttgagctgaacctggaagaccccggcacaggggatccctgggcagactcccggaggctgcactggcaggaccccctgaaggcctcagctctggcttgccctggagctcagggcctacggacgacgagggacgaggagcccgtgtctctcggatggagtgcgggggggctggcaccagcacccttcttgctgtgcccctggggtggggagcttggggcttccttggtcgcacccaccacctgcctgcccactggtcagccttcagggaccctgagcaccgcctggtctctttcctgtggccagcccagctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgg

SEQ ID NO: 190417 - DNA, 518 bp, Homo sapiens
  Payload ID: 17615
  Gene Name: tetraspanin 4
  ENST ID: ENST00000532375
  CDS Start-End: 122-518
gcagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgtacaacgccacgcgggtacctgactcctgctgcttggagttcagtgagagctgtgggctgcacgcccccggcacctggtggaaggcgccgtgctacgagacggtgaaggtgt

SEQ ID NO: 190418 - DNA, 968 bp, Homo sapiens
  Payload ID: 17615
  Gene Name: tetraspanin 4
  ENST ID: ENST00000527644
  CDS Start-End: 490-968
cggggtcgggggcgcgggggccgcagcgcgcgggccgggcagatgtttgggttccgccgccggggtccgagcggatccgcgcgacccgctgccaccgcgggggccagagcgggagcaggagcggggccggagcaggcgccggccggcgggatggggcgttccggggcggcgggtgcggggcgctgagcggcggccccggcacacccgggcgcgatgcgccgctccagcacggacgagtccacgtaccggcgcagcccctctccggagggcaaggagccggacttcgcgcgcggcggccccttccggcgctacagcagcctatacgggcgcgcgggcggcggggacgccgggggctccttcttcggcctgcacgcgaaccccggccccaaggcggcccaggcgcgctacacgtcgcccaagggcaacaagtacgtggttttctacctggacctctccttcatcttcctcctagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcactttcttcctgctgctgctgctggtgttcctgctggaggccaccatcgccatcctcttcttcgcctacacggacaagattgacaggtatgcccagcaagacctgaagaaaggcttgcacctgtacggcacgcagggcaacgtgggcctcaccaacgcctggagcatcatccagaccgacttccgctgctgtggcgtctccaactacactgactggttcgaggtgta

SEQ ID NO: 190419 - DNA, 818 bp, Homo sapiens
  Payload ID: 17615
  Gene Name: tetraspanin 4
  ENST ID: ENST00000530404
  CDS Start-End: 564-818
cgggaatggggtcggggtgcgccctcccgggtcccggctctgctggctgctcgccgtcccgagctcccgacgctcagacgcgcctctgagcacggggagaggggacccgggagggaggtcggggagggagtcgtggaagaggtgctttttgagctgaacctggaagaccccggcacaggggatccctgggcagactcccggaggctgcactggcaggaccccctgaaggcctcagctctggcttgccctggagctcagggcctacggacgacgagggacgaggagcccgtgtctctcggatggagtgcgggggggctggcaccagcacccttcttgctgtgcccctggggtgggggtgaggaaatggggggtcggtgtgcagtgagaggcaaagaaggctccttggaggtgcgagggctccactctgcccatctttccttttgcagagcttggggcttccttggtcgcacccaccacctgcctgcccactggtcagccttcagggaccctgagcaccgcctggtctctttcctgtggccagcccagaactgaagcgctgcggcatggcgcgcgcctgcctccaggccgtcaagtacctcatgttcgccttcaacctgctcttctggctgggaggctgtggcgtgctgggtgtcggcatctggctggccgccacacaggggagcttcgccacgctgtcctcttccttcccgtccctgtcggctgccaacttgctcatcatcaccggcgcctttgtcatggccatcggcttcgtgggctgcctgggtgccatcaaggagaacaagtgcctcctgctcact

SEQ ID NO: 190420 - DNA, 3365 bp, Homo sapiens
  Payload ID: 17616
  Gene Name: tetraspanin 5
  Uniprot ID: P62079
  ENST ID: ENST00000305798
  CDS Start-End: 404-1210
gcgaacgggcgggcgagcaagcgagcggcgtctccaccagcatctgccgcggccgcctttgcccgaagcccggggacgaaccgacggaccgaccgcctggcgcacggacgcgggcgctcgctttgtgttcggggctagcgtcggcgaggcttgagcttgcagcgcgcggcttccctgctttctcgcggccaccccggctccggcggcctcggcgcgcgaggggctggaggtgcgggagccgctctccgccggtcggtccccgcgcggctgagcccaggccgccagcgccgcggccccgtgcggtgtccctgagctcctgctccccgccgggctgctccgagcaacggtgcttcggagctccaaactcgggctgccggggcaagtgtcttcatgaacccagaggatgtccgggaagcactacaagggtcctgaagtcagttgttgcatcaaatacttcatatttggcttcaatgtcatattttggtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcagaaaatacattcttgtcctcatcttccgtaattggagggctgggagaggcagctttgctcttcaccacaccttggacggaccaccttctttctgttccatggcctgaaggagtgcatctcctcaaagactcagcccctcacctgggagggcagtggtttgtgggcatccctccatgtacattttaggaaacacttgcaactctcatctgaagaagaaaacaactcatctttgggttcagattttgtgatggtattcagcaagtcacttgggcgagcacacttggtctatcctggaaagtctccttataagagaagttgtgtatttcatgtgcaccgagcaagggcattggaagacgtcatgaggctgtattttagcaggactgatcgtttttctaagtagacctgagctttgtttatcagtgaaattcaaggagaaaatgaggttaatgaagaggtatcagttaaatatccccttcttctcaccctgccaaaattagcagttggatttttggaaactctggaatattctgggtcattttgttttgtatgtttgttgtttttcgtcttccaaaggtgaaagctatgatacagttccacttaaattttagtgttttcttactcagctcaagcattaatttttgattaagtcttaatctgcatgacctgtgaatctgaatccatcatctccctttcctgccagcttttctacaaacattgaaatatgttatttggtcagcacttatttcctaggttcacagccttgggaggttgtggcatgtcctcccagtctggctgggaagagaccagctgtaccatccaaatgcttccctggtcttgatgatctcttccagagtcgatctgagtggccttttctgcaccctccccttctttctctttgaatggaattaaacccaatttggaaacaacattgacccagtcaaaagcttctaatggtttctttttcttcctccagttttagtttgcttttattaaaaaaagaaaatagtgcatggccatagctccttcagttctcttattgcagactaaccatcaggatggtatcaaagcacaaatactttggaggggaatgcgttgaactggggcaagtactctgtaacacaaagtgggaaaccacttcctggtgctgccgctcctgcccccactttaggtgggagggacgagttttgccctctagattttaatccagctggtgtccaccggatgttgccctcctggggagcagatatcagtctgtggaactctgggaaaaccacaggcacatttttcggtgcggacagatttgccagcacataactgggcagccagctagaatactttgtggaaattaagcgaggttttccatttcagccccatggtgcatggtggtggccgatgaatgtgtcagtctgctcagagaaaggacaaaaaggaaattattttcaaaactgtgttcactgtttgggtgtgtgtatggctctgcatgtgtgtgtttttgtctctgtataggtagaggtattcacatcttactccgactgtaaggttgtcttacttcatctctgcccccaccacagttgccattttgtaatgtccttccaacatggagaagacacgagctctctccagttggcatcatttgtcttttttgttgattgcctcattctccagtgaactccatctggccaattgattcagaatcaggcaagatccctgccctttggcacatccactgaaaggccaaacagcaagtccgagtgagttttaaatattaattaatcaccctttattttttacacttgagagtgattgtaataaaggctgtcattaataaacttggttctacctta

SEQ ID NO: 190421 - DNA, 3242 bp, Homo sapiens
  Payload ID: 17616
  Gene Name: tetraspanin 5
  ENST ID: ENST00000508798
  CDS Start-End: 345-926
tgcccgaagcccggggacgaaccgacggaccgaccgcctggcgcacggacgcgggcgctcgctttgtgttcggggctagcgtcggcgaggcttgagcttgcagcgcgcggcttccctgctttctcgcggccaccccggctccggcggcctcggcgcgcgaggggctggaggtgcgggagccgctctccgccggtcggtccccgcgcggctgagcccaggccgccagcgccgcggccccgtgcggtgtccctgagctcctgctccccgccgggctgctccgagcaacggtgcttcggagctccaaactcgggctgccggggcaagtgtcttcatgaacccagaggatgtccgggaagcactacaagggtcctgaagtcagttgttgcatcaaatacttcatatttggcttcaatgtcatattttggtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatatattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcagaaaatacattcttgtcctcatcttccgtaattggagggctgggagaggcagctttgctcttcaccacaccttggacggaccaccttctttctgttccatggcctgaaggagtgcatctcctcaaagactcagcccctcacctgggagggcagtggtttgtgggcatccctccatgtacattttaggaaacacttgcaactctcatctgaagaagaaaacaactcatctttgggttcagattttgtgatggtattcagcaagtcacttgggcgagcacacttggtctatcctggaaagtctccttataagagaagttgtgtatttcatgtgcaccgagcaagggcattggaagacgtcatgaggctgtattttagcaggactgatcgtttttctaagtagacctgagctttgtttatcagtgaaattcaaggagaaaatgaggttaatgaagaggtatcagttaaatatccccttcttctcaccctgccaaaattagcagttggatttttggaaactctggaatattctgggtcattttgttttgtatgtttgttgtttttcgtcttccaaaggtgaaagctatgatacagttccacttaaattttagtgttttcttactcagctcaagcattaatttttgattaagtcttaatctgcatgacctgtgaatctgaatccatcatctccctttcctgccagcttttctacaaacattgaaatatgttatttggtcagcacttatttcctaggttcacagccttgggaggttgtggcatgtcctcccagtctggctgggaagagaccagctgtaccatccaaatgcttccctggtcttgatgatctcttccagagtcgatctgagtggccttttctgcaccctccccttctttctctttgaatggaattaaacccaatttggaaacaacattgacccagtcaaaagcttctaatggtttctttttcttcctccagttttagtttgcttttattaaaaaaagaaaatagtgcatggccatagctccttcagttctcttattgcagactaaccatcaggatggtatcaaagcacaaatactttggaggggaatgcgttgaactggggcaagtactctgtaacacaaagtgggaaaccacttcctggtgctgccgctcctgcccccactttaggtgggagggacgagttttgccctctagattttaatccagctggtgtccaccggatgttgccctcctggggagcagatatcagtctgtggaactctgggaaaaccacaggcacatttttcggtgcggacagatttgccagcacataactgggcagccagctagaatactttgtggaaattaagcgaggttttccatttcagccccatggtgcatggtggtggccgatgaatgtgtcagtctgctcagagaaaggacaaaaaggaaattattttcaaaactgtgttcactgtttgggtgtgtgtatggctctgcatgtgtgtgtttttgtctctgtataggtagaggtattcacatcttactccgactgtaaggttgtcttacttcatctctgcccccaccacagttgccattttgtaatgtccttccaacatggagaagacacgagctctctccagttggcatcatttgtcttttttgttgattgcctcattctccagtgaactccatctggccaattgattcagaatcaggcaagatccctgccctttggcacatccactgaaaggccaaacagcaagtccgagtgagttttaaatattaattaatcaccctttattttttacacttgagagtgattgtaataaaggctgtcattaataaacttggttctacctta

SEQ ID NO: 190422 - DNA, 605 bp, Homo sapiens
  Payload ID: 17616
  Gene Name: tetraspanin 5
  ENST ID: ENST00000515440
  CDS Start-End: 1-263
aagtcagttgttgcatcaaatacttcatatttggcttcaatgtcatattttggtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttgacaaacaataaaaacttgcctggaataatcttcgaacagaaggtatgagataagtattttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgca

SEQ ID NO: 190423 - DNA, 581 bp, Homo sapiens
  Payload ID: 17616
  Gene Name: tetraspanin 5
  ENST ID: ENST00000511800
  CDS Start-End: 241-357
accatctcgggctttgtgtaggatgcagatgccgtggtatatggtcctgtaattgcacgtaaataacgtttcctgcacgctctcctcttcagctggaaagcgctcccttttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttgaagagtccagtgttaactgaacaggcagaaaactacacatttctctaaatcagcaccttaatttataaagtctcatgttggaaatgaagagaattgtgttgtttcttggcttttaagacttggaaaatatcttaaatggcctctctccatttaggacaaacaataaaaacttgcctggaataatcttcgaacagaagttttctgtgttcctgggaattattttcttcctggagctcactgccggagttctagcatttgttttcaaagactgg

SEQ ID NO: 190424 - DNA, 574 bp, Homo sapiens
  Payload ID: 17616
  Gene Name: tetraspanin 5
  ENST ID: ENST00000515287
  CDS Start-End: 244-574
tttgtgtaggatgcagatgccgtggtatatggtcctgtaattgcacgtaaataacgtttcctgcacgctctcctcttcagctggaaagcgctccctgtgcgtaatggactgtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcg

SEQ ID NO: 190425 - DNA, 1191 bp, Homo sapiens
  Payload ID: 17616
  Gene Name: tetraspanin 5
  ENST ID: ENST00000505184
  CDS Start-End: 286-879
gttgccgcggctggtctgtgccatgctcagcgtgtatcttcttgcaccatctcgggctttgtgtaggatgcagatgccgtggtatatggtcctgtaattgcacgtaaataacgtttcctgcacgctctcctcttcagctggaaagcgctcccttttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcag

SEQ ID NO: 190426 - DNA, 710 bp, Homo sapiens
  Payload ID: 17616
  Gene Name: tetraspanin 5
  ENST ID: ENST00000511651
  CDS Start-End: 531-710
gcaccatctcgggctttgtgtaggatgcagatgccgtggtatatggtcctgtaattgcacgtaaataacgtttcctgcacgctctcctcttcagctggaaagcgctccctgaggacttaaatgcattggacagtggacaaagaccatttaaatggattacaaaaagcagacttcaccaggcagagcggcctctaacttcttcagtaatgttgccatttaccatgtgtctgttggggatcaggtccgtcgctaggcacccttcgtgcttttaggacattgccgtggaaggaaggggagaaaccttgatagggcccttggatgaagcactgcagcttatgctaagaagatcaaggccctgttagactggaaacattcattgtaagacctagtgccataagtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatc

SEQ ID NO: 190427 - DNA, 2206 bp, Homo sapiens
  Payload ID: 17617
  Gene Name: tetraspanin 6
  Uniprot ID: O43657
  ENST ID: ENST00000373020
  CDS Start-End: 113-850
agttgtggacgctcgtaagttttcggcagtttccggggagactcggggactccgcgtctcgctctctgtgttccaatcgcccggtgcggtggtgcagggtctcgggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaagatcgtgtttaaattaacttgtagaaaatctgctggaatggttgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacattctgcacatgtatcccagaacttaatgtaaacaaaaaaatcttaaagtgcaaatattaaaaaaaactgttctctgtgaaaaaaattatattccatgttataaagtagcatatgactagtgttctcctag

SEQ ID NO: 190428 - DNA, 3796 bp, Homo sapiens
  Payload ID: 17617
  Gene Name: tetraspanin 6
  ENST ID: ENST00000612152
  CDS Start-End: 490-879
ggcaccaggggccagggaggcccaatctcagagcgctgcgggctctgctggtgatagaaacaatatggtgaagttataaggagaggggaggggtggggggcgggaaagattccttaggatagaaaaaaaacaatgaagaaagctccacttgaagacctatgaaatttccgacactagaacctttgtatatagttttcggtaaccttcggcagggggcgctctgaaattgttgccactttccggacagcctcccatactttaccctctacaaaattgtacagtgtttccggcccttctcagttgtggacgctcatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaactgattggaatctttctcgcctactgcctctctcgtgccataacaaataaccagtatgagatagtgtaacccaatgtatctgtgggcctattcctctctacctttaaggacatttagggtcccccctgtgaattagaaagttgcttggctggagaactgacaacactacttactgatagaccaaaaaactacaccagtaggttgattcaatcaagatgtatgtagacctaaaactacaccaataggctgattcaatcaagatccgtgctcgcagtgggctgattcaatcaagatgtatgtttgctatgttctaagtccaccttctatcccattcatgttagatcgttgaaaccctgtatccctctgaaacactggaagagctagtaaattgtaaatgaagtaatactgtgttcctcttgactgttatttttcttagtagggggcctttggaaggcactgtgaatttgctattttgatgtagtgttacaagatggaaaattgattcctctgactttgctattgatgtagtgtgatagaaaattcacccctctgaactggctccttcccagtcaaggttatctggtttgattgtataatttgcaccaagaagttaaaatgttttatgactctctgttctgctgacaggcagagagtcacattgtgtaatttaatttcagtcagtcaatagatggcatccctcatcagggttgccagatggtgataacagtgtaaggccttgggtctaaggcatccacgactggaagggactactgatgttctgtgatacatcaggtttcagcacacaacttacatttctttgcctccaaattgaggcatttattatgatgttcatactttccctcttgtttgaaagtttctaattattaaatggtgtcggaattgttgtattttccttaggaattcagtggaacttatcttcattaaatttagctggtaccaggttgatatgacttgtcaatattatggtcaactttaagtcttagttttcgtttgtgcctttgattaataagtataactcttatacaataaatactgctttcctctaaaaagatcgtgtttaaattaacttgtagaaaatctgctggaatggttgttgttttccactgagaaagctaagccctacatttctattcagagtactgtttttagatgtgaaatataagcctgcggccttaactctgtattaaaaaaaatgtttttgtttaaaaaaaactgttcccataggtgcagcaaaccaccatggcacatgtatacctatgtaacaaacctgcacattctgcacatgtatcccagaacttaatgtaaacaaaaaaatcttaaagtgcaaatattaaaaaaaactgttctctgtgaaaaaaattatattccatgttataaagtagcatatgactagtgttctcctagagatcagacttttttgattgtatagtttgcattaaaaagttgtacagggagggatgtaacctgtatcttcaggataatagggaaattaataaggaaaataataattactaaaatttgagttgaagtcagggaattatttctttggttttgagtctctttatacatccattagtagaacctgtctagtctgattgccacagtccttgaattgatggtaagggggagtcagttacagttagaaaaaaacctgggcaaaaactactagttaaatgatcatgaattttgagtatgtgttttaaaatgcttggagttattgcagaaaaatgatattctccattagaacatttgatgtgtgacttttgacataggataaggtgataagaaaattaagttgaaaaatagtgactcaagtacagcaaatcagatttttggctactgagattaaagaagcaaatatttaaaggattatcagcaattttcaaatacatatttttcactgcagtggttttgaagaatgttttaaggttatatttagagtttttaaaaaagttttccctcagccagccatggtggctcacatctgtaatcccagcactttgagaggctgaggcgggcggatcacctgaggtcaggagttctagaccagcctggccaacatggtaaaacaccgtctctaataaaaatgcaaaaattagctgggtgtggtggcaagcacctgtaatcccagctacttgggagactgaggcaggagaatcacttgaatccaggagtcagaggttgcagtgagccgagatcacaccactgcactccagcctgggcgataagagtgaacctgcatctcagaaaaaaaaaaaaagttttccctcattattaaaaaggaaaaattatagaaaattaaaatatagaatgtagaaagaggaaaaacaccacacatcactcgtcaggtggattggtttgtttatttttaagatgggtttattttggatagccagttagaaaacgcccttatagctgatgtgtgcttgtgcatactgaattgtatacttaattctgaaagtaatgaggaaacatttcacctaatgataactggtacaaaggaaagttcacgtgtctttaatagtttgctaattagactagctggttagaaagagggatcactagattggagagagagatccagtttccactggaggcagtaggtctgctcatttccatggtgacaatcctaatggcagagggagtgagtttcccttagtggcacaggctgggggttttgagcttttaagttttgttttatagaaatctggagaattttacattttacttcactatatatctatgtttaaaataattcatttttgatgtcccaaaattgatgtgggttgccttatttccaggcaccaggttgctcactgcaaggtgacattttgagaagcagaaatctctaggtatatcttaagtgtgaaaagcttgttagatttccatggcctattccaggtgggttgttgggtttatgttgtaagcatcaaacttttgtggaaataaatacctaatacaaggt

SEQ ID NO: 190429 - DNA, 900 bp, Homo sapiens
  Payload ID: 17617
  Gene Name: tetraspanin 6
  ENST ID: ENST00000614008
  CDS Start-End: 490-900
ggcaccaggggccagggaggcccaatctcagagcgctgcgggctctgctggtgatagaaacaatatggtgaagttataaggagaggggaggggtggggggcgggaaagattccttaggatagaaaaaaaacaatgaagaaagctccacttgaagacctatgaaatttccgacactagaacctttgtatatagttttcggtaaccttcggcagggggcgctctgaaattgttgccactttccggacagcctcccatactttaccctctacaaaattgtacagtgtttccggcccttctcagttgtggacgctcatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctgccatcgtaggatttgttttcagacatgagattaagaacagctttaagaataattatgagaaggctttgaagcagtataactctacaggagattatagaagccatgcagtagacaagatccaaaatacgttgcattgttgtggtgtcaccgattatagagattggacagatactaattattactcagaaaaaggatttcctaagagttgctgtaaacttgaagattgtactccacagagagatgcagacaaagtaaacaatgaaggttgttttataaaggtgatgaccattatagagtcagaaatgggagtcgttgcaggaatttcctttggagttgcttgcttccaagacatt

SEQ ID NO: 190430 - DNA, 1270 bp, Homo sapiens
  Payload ID: 17618
  Gene Name: tetraspanin 7
  ENST ID: ENST00000286824
  CDS Start-End: 4-804
agtatggcatcgaggagaatggagaccaaacctgtgataacctgtctcaaaaccctcctcatcatctactccttcgtcttctggaaagaaaaggctgcaggattttgtggcagacaggatgtggctatggctttgatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttt

SEQ ID NO: 190431 - DNA, 1909 bp, Homo sapiens
  Payload ID: 17618
  Gene Name: tetraspanin 7
  Uniprot ID: P41732
  ENST ID: ENST00000378482
  CDS Start-End: 178-927
gtaggagccccgcgcggtgcgcgctcacgcacgcgcacggcctcgcctgcgcgctcacgaggcctctcgcggcacgcgcccccgccccgcgccgccccgccccgccccgcctcttccccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctggatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgacttaatctcatttggtttgattttccctctactaaggctttcctaccttcttcaggctgcctaagacatgtaacgaaacacttcaataattgtccatgaggagaaaaaaagcatgtgtcatgcatgaaggaaactgaacttgaggtggcctccttgcttgttacatacctgggtatgtgtaggcagtttagtgcatctttgcctctcggttgaaacctgtataaccctgttacaaagctgtgttgttgcttcttgtgaaggccatgatattttgtttttccccaattaattgctattgtgttattttactacttctctctgtattttttcttgcattgacattatagacattgaggacctcatccaaacaatttaaaaatgagtgtgaagggggaacaagtcaaaatatttttaaaagatcttcaaaagtaatgcctctgtctagcatgccaacaagaatgcattgatattgtgaacatttgtgatatatgtattaataaatagagcaattac

SEQ ID NO: 190432 - DNA, 1224 bp, Homo sapiens
  Payload ID: 17618
  Gene Name: tetraspanin 7
  ENST ID: ENST00000475216
  CDS Start-End: 4-141
agtatggcatcgaggagaatggagaccaaacctgtgataacctgtctcaaaaccctcctcatcatctactccttcgtcttctggccttgcctactgaagagaataagaagctgggtttctcctcatttacataacaagtaatatggtatggaagatggaaccgaagatttgaggtcagaagacctaagttctatggcttttctacaacctagatgatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgact

SEQ ID NO: 190433 - DNA, 1210 bp, Homo sapiens
  Payload ID: 17618
  Gene Name: tetraspanin 7
  ENST ID: ENST00000471410
  CDS Start-End: 6-197
gtagtatggcatcgaggagaatggagaccaaacctgtgataacctgtctcaaaaccctcctcatcatctactccttcgtcttctggccctatttttgctttgaaactggagcacagtgctgtatgaggtaccgagaatcagctagatggcaaaccggactgtttgcaatggtcaaggaagaagcagagatttattgaggatcaaaaatattcctaatgcacccggacatttccttatcgctggcgttggtggttcttcaagtcagggaaggtctatagaagaggagggaaaaacacacctaggaatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagacttacaatggcaatgatgagaggagccgggcagtggaccatgtgcagcgcagcctgagctgctgtggtgtgcagaactacaccaactggagcaccagcccctacttcctggagcatggcatcccccccagctgctgcatgaacgaaactgattgtaatccccaggatctacacaatctgactgtggccgccaccaaagttaaccagaagggttgttatgatctggtaactagtttcatggagactaacatgggaatcatcgctggagtggcgtttggaatcgcattctcccagttaattggcatgctgctggcctgctgtctgtcccggttcatcacggccaatcagtatgagatggtgtaaggagaagtctttcaagaatgacggaataagagacctgttttaaaaaggaactgcagcaatctttgaaagacttccaaagaatgttagagcacagtacataatacacttgccctgctccctctcccccttaccccacaacgtgcaactgacactcccacccagtctctgctccacctttcagcccacgtcacgtgtagtgtccattttgtgaagccctgttgtgccacagagtgtagc

SEQ ID NO: 190434 - DNA, 553 bp, Homo sapiens
  Payload ID: 17618
  Gene Name: tetraspanin 7
  ENST ID: ENST00000480976
  CDS Start-End: 4-135
agtatggcatcgaggagaatggagaccaaacctgtgataacctgtctcaaaaccctcctcatcatctactccttcgtcttctggattcattcccatccaaaattcacgaggacacagccaataaaagggagctgaatttgaagaagagctcgtcactaagattcattctgtatttattgagctgattctgtttgatggatattaggacagaatatttgaacagcatgttgtcttggaaaatcagatcactggggtgatcctgctggctgttggagtctggggcaaacttactctgggcacctatatctcccttattgccgagaactccacaaatgctccctatgtgctcatcggaactggcaccactattgttgtctttggcctgtttggatgctttgctacatgtcgtggtagcccatggatgctgaaactgtatgccatgtttctgtccctggtgttcctggctgagctcgtagctggcatttcagggtttgtgtttcgtcatgagatcaaggacaccttcctgaggacttacacggacgctatgcagact

SEQ ID NO: 190435 - DNA, 1227 bp, Homo sapiens
  Payload ID: 17619
  Gene Name: tetraspanin 8
  Uniprot ID: P19075
  ENST ID: ENST00000247829
  CDS Start-End: 280-993
gtgccattctcttgcctgatccagtgccattcccttcacttgatatctgtttactttagaggaggcagtttttgagaaaggatcataaatatcctggcccagtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttac

SEQ ID NO: 190436 - DNA, 1516 bp, Homo sapiens
  Payload ID: 17619
  Gene Name: tetraspanin 8
  Uniprot ID: P19075
  ENST ID: ENST00000393330
  CDS Start-End: 554-1267
gctttgtagtagagatagctgttcaggaggaggaaatgtgaattctgagagcgtgatcatttaggagagatttccattcctggaacgatatcactaccacatgcacgagtgcaattgaagggaaacctggtggggaaacagttttaacattctttcagaaaaagaatcactacctagtggaaaatgttgtgcaagcctcttcatgtttcttccctccagaaaacaactaaacagatggaagaactggttcacaaacatcccaactctctcctgccaaggtccagtgggcttgttgctccagacctcatgccttctggacccagacatctctgcaatctcggaactggaatacaccacttcttgtcaaggtactagcaagttgactatgaactgctgggagataagaccatctgatttatccgtgtacatacagcagctagcacaccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttggtgcttttcta

SEQ ID NO: 190437 - DNA, 1168 bp, Homo sapiens
  Payload ID: 17619
  Gene Name: tetraspanin 8
  Uniprot ID: P19075
  ENST ID: ENST00000546561
  CDS Start-End: 222-935
gtgtgggttaatagcctttgcgatatttaaatgtgtgggttaatttttttatccagtttaataactttttattcctccctctacttctttgctttctctttctgctctgaagccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgttta

SEQ ID NO: 190438 - DNA, 4323 bp, Homo sapiens
  Payload ID: 17620
  Gene Name: tetraspanin 9
  Uniprot ID: O75954
  ENST ID: ENST00000011898
  CDS Start-End: 162-881
ctgtttccgctggcggcggcggcggcggcggtgccggagcgcgagcagagcggagacccccaggtcctgcgggcgcggaatatcctggaaccttcttttgtttgtcagcagccaaggtgtttccaggaagttcagagagaacagaatttaagaagtgcaacatggccaggggctgcctctgctgcttgaagtacatgatgttcctcttcaatttgatattctggctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagtgctgggggagaacacggttcccgaccgctgctgcatggagaactcccagggctgcgggcgcaacgccaccacgcctttgtggagaacgggctgctatgaaaaggtgaagatgtggttcgatgacaataagcacgtgctgggcacggtggggatgtgcatcctcatcatgcagatcctgggcatggccttctccatgaccctcttccagcacatccaccggactggtaagaagtacgacgcatgagcgggctggccgggagtgcccaccccgccctgctgccctgtggagggaagaggattgagctttgtgtcacctgcctgcgctctccagatatgacccctgcacccaccccccacagcctgccctaccccacctaccctgcctcagcctcggacttctcagtgggtggagtgccagggaggaggaggcacacggagacctggggctcggggcccctggattcctgcatctgcatatgcgtatttgccaaagacgacagggtgggctggggtgcgctccggaggaacccccggcactgatgggcttctgcccctgcccttcctcacactgacactttgtccccacatggggtggggagcagagtgcccgccccgtggagataccgccccagcgggggctgcgacatccatggccaccatggggcacctggcggggcgggggtctgccggcctctgggcaaggcccctggagcatctcgcccaggctttttataccttacaatgtaacttttttattttattttactctatgattattcaggaatattatctctcagataagtttagggttagatttctgatttgtaactttttactgtgttgatttctttaatggtttgactttttttccctgagggtgagggatgggtgggaagagaggacatctgtccagtctcaatcaggacagaccaccgtgcgacacccaggaggctctcggatggggcgcgcctgcgccctcagaacgtgtgggaaggagggggcgtggacaggacacgggaccttgccaggcctggtgtctgaggacaggagcctgggagaggcgggtggagcgtgaagcaggctggaggtgcccctgcacgggaggtggcgtttgctaaccaatcgagctggaaatgccagggcaggggggccccacggtgctgtggcagagctagaggggtccttagacttttcactgatgagcagttgttggttttttctttctcccttcctcccgctctctgctggcacgcgaggcttccccttccaccccatgtgggtattcccacaacaggttctgcacaccccagttatttcacagacattcctgctagaaactgtcagacaaatacctctctagttcggatgctgctcactttcccccttgcttctggaaggggaagcagtccttaggttttgctgtgctgggacagtggcaggggacccacaggggtgaggacccacggtcctccccgccagccttgctcagctgtgggttgccctgctgggaaggagggaatcacgtccacctgggtcccaagatcttcgcctccttccctggggccacggacatcagcagtgggttgggtggcgattatatcatctgtgatcccaaggagaagaaatacagaaaacccaagagaggtcagactggctcttgttaccggagccacgggaagaaagcagccggagtcacgcacgtgcagagctgggcatgggagagaaacgggctggggagtgaggccaggagtgggattcagctgcagcagggcgccccctccaaactgcagctggtctggcttactgttttgccgttcaaaaaggtcgcgaatccgtgggactgagcacggggacctcacccgctagccagcgtctgctgcacttgatcaggtggggccttggtgggcggctgcctttcctatacagtttgtcttgtcaccctggtttcccactggggccaggtctcttctccagcctccacctgcctgtctgatccaagagctgagacacggccacccagcaccagtcactcctctgttcaccttaagtaacacacaaatcgggaacaggaggacagaaccgttggcattatcaggattcgtgttttgtgggggtgggagtggagagtagggtggtcttgtgagttgtgcagggtgaagaccgcttccctgagacaggggcagtggtgctgatggaatgtgggggaggcccacatttgagcaaagctgccctgcccttgtcccctggcctggcttcctggtaaggagtttcagccgcctccgcaggaacccccaaagtgcagattccggagcagacacatccgggcggagagactcagcagacaagtgctgcagttgcacggtgggacccggggcctcgtgcgttttttgctgtgggtggggtgggtgggttggtttatgcctatcaatgcaatttttaatttttgttaatatcaacagcaaaagcctagtgcattgggagatgtgcaacctccctgaaaatcttttctgtttctggagtacttcaggggtggcctctggccccagagcctttgccacagtgctcccaccagcccccacctcatccgtctgtttgcagagcctcatctacaggtccccacgctgccttctttactcactctgcgcttggccgttttgttatttggcttagtctacattgggcggaagtctgtgtgcacagagtgggtgttccttcgagccccttccactcagagggccacacccagcgatgccagtgaaggtggcacagcctctcttcagtttctcctgactgtgatctcactggggtagaattcccctgagagaattccctcactcacggctccctttgccagagtcagttcaatcaggtctgatgtgagcaatttacacacttgtctcagaaagtccctcagggtttgtagaggactgcaggggggcatccgctgcagactcagcctttctctgcagccatcctgcagtgggggtgagcgggcacaggctgagaactgctcttgggtggtggaagcaggtgtcacggtgcaagtctccccctgcacccctcccccagcttgagccgtgtcacccccctctccctccagcatgggcctgtgtctcaggctctctggaaggtggccctgccccggaccctcttgcaggtgtcctggtttgacttggaactagatggccatctttccaggctttggtggcccaagagcagtctgggtggatggaagtggctgtcccctcctctccagcccctgcccacccactggtggaggtgctaactagcagggacgtggcataggatgggagctgggcgtgaggtgcttggggtccattctttgtccctcagcttctcagagtccggccagcccttgtgttcccgtgccccacactttcctcctccccactgcagtgagtcaatagtccagggtggggcctggcctccctgccctgattggggactcaggaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagc

SEQ ID NO: 190439 - DNA, 958 bp, Homo sapiens
  Payload ID: 17620
  Gene Name: tetraspanin 9
  ENST ID: ENST00000407263
  CDS Start-End: 20-835
agaatttaagaagtgcaacatggccaggggctgcctctgctgcttgaagtacatgatgttcctcttcaatttgatattctggctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagtgctgggggagaacacggttcccgaccgctgctgcatggagaactcccagggctgcgggcgcaacgccaccacgcctttgtggagaacgggctgctatgaaaaggtgaagatgtggttcgatgacaataagcacgtgctgggcacggtggggatgtgcatcctcatcatgcaggtaagaggggcgtccccagcagcctcacccaccctgctggcctcagcctcagagggaaggaagcacagagaagtgaaagcagtgttggtacacggcggagggtctggaattcatcacagctattcaagcttagcagctgtgcctgccaccgtttccgcagagctctgatatgagagcacgtgtctactcagcactgagagtggtgctcagggctgcctgtggccaggcccaggctgggatattgaagctggagtcaacccccgtgggttcccccagttctgcccaaacctt

SEQ ID NO: 190440 - DNA, 570 bp, Homo sapiens
  Payload ID: 17620
  Gene Name: tetraspanin 9
  ENST ID: ENST00000444315
  CDS Start-End: 162-341
ctgtttccgctggcggcggcggcggcggcggtgccggagcgcgagcagagcggagacccccaggtcctgcgggcgcggaatatcctggaaccttcttttgtttgtcagcagccaaggtgtttccaggaagttcagagagaacagaatttaagaagtgcaacatggccaggggctgcctctgctgcttgaagtacatgatgttcctcttcaatttgatattctgggatcctccagttggtgagaatgggctgactgggctcgcagagggcggatcagttttctcgtgccaggaagtcgtggaatcgggaggtcatctggctcgtcctgcgctgagcatttgaacacagggctgtcaagggagagctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctg

SEQ ID NO: 190441 - DNA, 4284 bp, Homo sapiens
  Payload ID: 17620
  Gene Name: tetraspanin 9
  Uniprot ID: O75954
  ENST ID: ENST00000537971
  CDS Start-End: 117-836
attcccgggcaggccccgccccctgtttccgctggcggcggcggcggcggcggtgccggagcgcgagcagagcggagacccccaggtcctgcgggcgcgaatttaagaagtgcaacatggccaggggctgcctctgctgcttgaagtacatgatgttcctcttcaatttgatattctggctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagtgctgggggagaacacggttcccgaccgctgctgcatggagaactcccagggctgcgggcgcaacgccaccacgcctttgtggagaacgggctgctatgaaaaggtgaagatgtggttcgatgacaataagcacgtgctgggcacggtggggatgtgcatcctcatcatgcagatcctgggcatggccttctccatgaccctcttccagcacatccaccggactggtaagaagtacgacgcatgagcgggctggccgggagtgcccaccccgccctgctgccctgtggagggaagaggattgagctttgtgtcacctgcctgcgctctccagatatgacccctgcacccaccccccacagcctgccctaccccacctaccctgcctcagcctcggacttctcagtgggtggagtgccagggaggaggaggcacacggagacctggggctcggggcccctggattcctgcatctgcatatgcgtatttgccaaagacgacagggtgggctggggtgcgctccggaggaacccccggcactgatgggcttctgcccctgcccttcctcacactgacactttgtccccacatggggtggggagcagagtgcccgccccgtggagataccgccccagcgggggctgcgacatccatggccaccatggggcacctggcggggcgggggtctgccggcctctgggcaaggcccctggagcatctcgcccaggctttttataccttacaatgtaacttttttattttattttactctatgattattcaggaatattatctctcagataagtttagggttagatttctgatttgtaactttttactgtgttgatttctttaatggtttgactttttttccctgagggtgagggatgggtgggaagagaggacatctgtccagtctcaatcaggacagaccaccgtgcgacacccaggaggctctcggatggggcgcgcctgcgccctcagaacgtgtgggaaggagggggcgtggacaggacacgggaccttgccaggcctggtgtctgaggacaggagcctgggagaggcgggtggagcgtgaagcaggctggaggtgcccctgcacgggaggtggcgtttgctaaccaatcgagctggaaatgccagggcaggggggccccacggtgctgtggcagagctagaggggtccttagacttttcactgatgagcagttgttggttttttctttctcccttcctcccgctctctgctggcacgcgaggcttccccttccaccccatgtgggtattcccacaacaggttctgcacaccccagttatttcacagacattcctgctagaaactgtcagacaaatacctctctagttcggatgctgctcactttcccccttgcttctggaaggggaagcagtccttaggttttgctgtgctgggacagtggcaggggacccacaggggtgaggacccacggtcctccccgccagccttgctcagctgtgggttgccctgctgggaaggagggaatcacgtccacctgggtcccaagatcttcgcctccttccctggggccacggacatcagcagtgggttgggtggcgattatatcatctgtgatcccaaggagaagaaatacagaaaacccaagagaggtcagactggctcttgttaccggagccacgggaagaaagcagccggagtcacgcacgtgcagagctgggcatgggagagaaacgggctggggagtgaggccaggagtgggattcagctgcagcagggcgccccctccaaactgcagctggtctggcttactgttttgccgttcaaaaaggtcgcgaatccgtgggactgagcacggggacctcacccgctagccagcgtctgctgcacttgatcaggtggggccttggtgggcggctgcctttcctatacagtttgtcttgtcaccctggtttcccactggggccaggtctcttctccagcctccacctgcctgtctgatccaagagctgagacacggccacccagcaccagtcactcctctgttcaccttaagtaacacacaaatcgggaacaggaggacagaaccgttggcattatcaggattcgtgttttgtgggggtgggagtggagagtagggtggtcttgtgagttgtgcagggtgaagaccgcttccctgagacaggggcagtggtgctgatggaatgtgggggaggcccacatttgagcaaagctgccctgcccttgtcccctggcctggcttcctggtaaggagtttcagccgcctccgcaggaacccccaaagtgcagattccggagcagacacatccgggcggagagactcagcagacaagtgctgcagttgcacggtgggacccggggcctcgtgcgttttttgctgtgggtggggtgggtgggttggtttatgcctatcaatgcaatttttaatttttgttaatatcaacagcaaaagcctagtgcattgggagatgtgcaacctccctgaaaatcttttctgtttctggagtacttcaggggtggcctctggccccagagcctttgccacagtgctcccaccagcccccacctcatccgtctgtttgcagagcctcatctacaggtccccacgctgccttctttactcactctgcgcttggccgttttgttatttggcttagtctacattgggcggaagtctgtgtgcacagagtgggtgttccttcgagccccttccactcagagggccacacccagcgatgccagtgaaggtggcacagcctctcttcagtttctcctgactgtgatctcactggggtagaattcccctgagagaattccctcactcacggctccctttgccagagtcagttcaatcaggtctgatgtgagcaatttacacacttgtctcagaaagtccctcagggtttgtagaggactgcaggggggcatccgctgcagactcagcctttctctgcagccatcctgcagtgggggtgagcgggcacaggctgagaactgctcttgggtggtggaagcaggtgtcacggtgcaagtctccccctgcacccctcccccagcttgagccgtgtcacccccctctccctccagcatgggcctgtgtctcaggctctctggaaggtggccctgccccggaccctcttgcaggtgtcctggtttgacttggaactagatggccatctttccaggctttggtggcccaagagcagtctgggtggatggaagtggctgtcccctcctctccagcccctgcccacccactggtggaggtgctaactagcagggacgtggcataggatgggagctgggcgtgaggtgcttggggtccattctttgtccctcagcttctcagagtccggccagcccttgtgttcccgtgccccacactttcctcctccccactgcagtgagtcaatagtccagggtggggcctggcctccctgccctgattggggactcaggaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagcacagca

SEQ ID NO: 190442 - DNA, 10481 bp, Homo sapiens
  Payload ID: 17621
  Gene Name: tetratricopeptide repeat and ankyrin repeat containing 1
  Uniprot ID: O15050
  ENST ID: ENST00000429976
  CDS Start-End: 249-9026
cttggaataggtctgcggctgcacaccgcccggacgccggggttcctgcgtcccccgccccctctgatcgcggctgggtagccgagccgcaggcagctgggggcccccgaacgccgcctctgcatcgcgccgcccctgccccgggctccggtagctttcgggcttccgcactgcccgccgcgccctgcccacagggaagcgcttccccaggcggcggcggtcctggtgcggaccctccggccgcagccatgtgggacccgcgggcagctagggttcccccgagggacttggctgtgctgctgtgcaacaaatcaaatgcatttttcagccttgggaagtggaatgaggcatttgttgctgccaaggaatgtctccaatgggatccaacctacgtgaagggatactaccgagctggttattccttgctgaggttgcaccagccttacgaagccgctcgcatgttttttgagggtctgcgacttgtgcagagaagccaagaccaggcaccggttgctgatttccttgttggagtcttcaccactatgagcagtgactccattgttttgcaaagtttcttgccttgctttgatcatattttcacaactggattcccaacagaagtgtggcaatctgtaatagaaaagttggcaaagaaaggattatggcattcatttctgcttctgtcagcaaaaaaagaccgattaccaagaaatattcatgtcccagagttatcactgaaaagtctctttgagaaatacgttttcattggactttatgagaagatggaacaagtgcccaagttagtccagtggctcatctccattggtgcaagtgttgagactataggaccgtatccccttcatgccctcatgcgactctgtatccaagccagagaaaaccatcttttccggtggttaatggatcacaagcccgagtggaaaggccgcattaaccagaaggatggggatggctgcactgtcctgcacgtcgtcgctgcccactccccaggatacctcgttaagcgacaaacagaggatgtgcagatgctcctgcgctttggggcagatcccactttgctggatcgacagtctcggtctgttgtggatgtcctgaagaggaataagaacttcaaagccatcgagaaaatcaacagtcacttagaaaagctagctacgtgttctaaggacctatcaggattcagcaatggtgatggacccactagtgaaaacgacattttcaggaaggtcttggagcagctggtgaagtatatgaactcaggaaaccggttattgcataaaaactttctgaagcaggaagtagttcagaggttcttgcgtctcctttctactctgcaagaaattcctcctgacctggtctgtgatattaatcaagactgtgccaccaccgtcttcaaattcttattggaaaaacagagatggcctgaggtgcttctgctgctgacccgcaaagtaagtggagaaccaccgcttggggattgcctcatcaaagactgcaacttctcagacctcgacatctgtaccatcatcccccatctcagcacctgggaccagcggaagaaacagcttctgggctgcctgatagacagtggagccttgcctgatggtcttcaggagagccaggagaggccagttgtcacgtgcctgaaacatgaggacttcgagttggctttccttctcttgaccaagggcgcagacccccgtgctatttctctcacggaaggtgatactcctttgcatgcagcactccacatctttctagagattaaagctgacattggttttagcttcctcagccatctgttggatctgttttggtccaaccccactgaattcgactacctcaaccccaatgtccaggacagcaatgggaacacgctgatgcacatcctcttccagaagggcatgctaaagcgcgtgaagaagctgttagacctgctggtgaagtttgacatcaacttcaatctgaagaacaaagagggcaaagatgcacggcaccggattaagaagaacgactctctgctcttggcctggaacaaagctctgatggagaacaggaggaggagccggcaggactctgctgcccacctggggaagctctcaaagtccactgcccctggtcacacatctcagctcaagtcccagggttcattcaagtcagtgccatgtggtgccactgccagaacactgcctgaaggaagtgcagtccctgacagctgggagactctcccaggtacccaggtgaccaggaaggagcctggagctctcaggccctgctcgctgagagactgccttatgcaggacatcacagttttgattcagcaggttgaagtggatccgtctttcccagaggactgtcttcagagctctgagcctctggaggcaggagctggcaaagaaggaaagaaagatgacaagccgactctgggtgcaggggcccctgactgtagtgaggtgggggaaggacatgctcaggtgggccttggggccttgcagcttgtgcctgatgataacagggggaaggagggcaatgatgatcaggatgactggagcacgcaggagattgaggcctgcctccaggacttcgataacatgacctgggagatcgagtgcacttcagaaatgctgaagaagctgtctagtaaggtaatgaccaaggtcatcaagaagaaaatcatccttgccattcagcagctgggaaatggcgagtggacccagggcctgcagaagcgactgaagcacctgaaaggaagcatccagctcttcgaagctaagctggacaaaggagcccggatgctctgggagctcgccattgacttctcccctcgatgcagtgagaaccctgagaagatcattgccacggagcagaacacgtgtgcaatggagaaatcagggcggatctacacggaaatcatccggatttgggacatcgtcttagatcactgcaaactggctgattccatcaaggccatctgcaatgcctacaaccggggcttgtcctgtgtcctgcggaagaagctgaaaggtatcaataaaggccaagtgtcagctaacatgaaaattcaaaagcgtatacctcgctgctatgtggaggacacagaggccgagaagggcagggagcatgtcaatcctgagtactttcccccagccagtgcagtggagacagaatataacatcatgaagttccacagcttcagcaccaacatggcctttaacatcctcaatgacacgacagccacagtggagtaccccttccgggtgggtgagcttgagtacgcggtgatcgacctcaatcccaggccactggagcccatcatccttattgggcgaagtggcactgggaagacaacctgctgcttgtacagattgtggaagaaattccacgtttactgggaaaaagctgagcaggcaggaagcccattgctggccaaacaggtctggctgaagagaaggttggaagtggaacccggaaaagagagtccaggtggggaggaagaggaggaggaagaggacgaggaagaggaagattctattgaagtggaaacagtagaaagcatagatgagcaggagtatgaagcctgcgcaggaggagccggtgtggagccagcaggggacggccaagctgcagaagtatgtgcaccagaacatccccaccagctggagcatttacatcagatctttgtgaccaagaaccatgtgctgtgccaggaggtacaaaggaatttcattgagctttccaagtccaccaaggccactagtcattacaaaccactggaccccaacattcacaaactccaggacctgagggacgagaactttcctctgtttgtcacttccaagcagctgcttcttctgcttgatgcttctctgcccaaaccattttttctgagaaacgaagatggaagcttgaaaagaaccatcataggatggtctgcacaggaagagtcaaccattcctagttggcaagaggatgaagaggaggctgaggtggatggggactacagtgaggaggataaagctgtagaaatgcgtacgggtgacagtgacccccgggtgtacgtgacgtttgaggtgttcaaaaatgaaatatggcccaaaatgaccaaagggaggactgcctacaaccctgcactgatttggaaagaaataaaatcttttctaaagggttcttttgaggccctcagctgtccccatgggagactcactgaagaagtatataagaaattagggaggaaacggtgccccaatttcaaggaagaccggagtgagatctacagcctcttcagtctgtatcagcaaatcaggtcccagaaaggttattttgatgaagaggatgttctgtacaacatatcccggaggctgtcgaagctcagggtgctcccatggtccatccacgagctctatggtgatgagattcaagactttacccaggccgagctggcgctgctgatgaaatgcatcaatgaccccaactctatgttcctcacgggggacacggcccagagcatcatgaagggcgtggccttccgcttcagcgatctgcgctctctgttccattatgccagcagaaacaccatagacaagcagtgtgctgtccggaagcccaagaagatccaccagctgtaccagaattacaggtcccactcaggaatcctcaatctggcatctggagtggtggatttacttcagttctatttcccagaatcttttgatcgccttccaagggattctggcctctttgatggtcctaagccaactgttctggagtcttgtagtgtaagcgacttggcaattttgctacgagggaataaaaggaaaactcagcccattgaatttggagcccaccaggtaatccttgtggccaatgaaacggcaaaggagaaaattccagaagagctggggttagcacttgtgctaacaatttatgaagcaaaaggcttagaatttgatgatgtcctcctttacaacttttttactgattctgaggcttataaggaatggaagatcatttcctcattcacacctacctcaactgactccagagaggaaaaccggccattggttgaagtacccctggacaaaccaggctcttctcagggtcgatctctcatggtgaatccagaaatgtacaagctcctcaacggagagctgaagcagctgtacaccgccatcacacgggctcgggtcaacctctggatctttgatgaaaaccgagagaaacgggctcccgcattcaaatatttcattagaagagattttgtccaagttgtaaagacagatgaaaataaagactttgatgatagcatgttcgttaagacctcaactcctgcggagtggattgcacagggagattactacgccaagcaccagtgctggaaggttgcagccaagtgttaccagaaaggaggtgcatttgagaaggagaagttggccctggcccatgacactgccctgagcatgaaatccaagaaagtcagccccaaggaaaagcagttggaatatttggaattggctaagacctatttggagtgcaaagagccaacactgtcccttaagtgtctgagctatgccaaggagttccagctctctgcccagctgtgcgagaggctgggaaagataagagatgctgcctatttctataagcgaagccagtgctacaaagacgctttcagatgctttgagcagattcaggaatttgatctagcactcaaaatgtactgccaagaggagctttttgaagaagctgctattgcagtggaaaagtatgaagaaatgctaaagactaagacccttcccatttccaagctctcctattctgccagtcagttttacttggaagctgcagcaaagtatctgagtgcaaataagatgaaggaaatgatggctgtcctctcaaagctagacatagaagaccagctggtgttcttgaagtctcggaaacgcttagcagaagctgcagacctgctgaacagggaaggtaggagagaagaggctgccctgctgatgaagcaacatggctgcctcctggaggctgccaggctcactgccgacaaggacttccaggcctcatgtctgctgggggccgcccgcctcaatgtggccagggattccgacatagaacacaccaaggacattctgagagaagcacttgatatctgctatcaaactggccagttgtctggcattgcggaggcccacttcctgcaaggggtaatcctgagagactttcagaagctcagggatgccttcttcaagtttgacacgctcaaccactcagctggagtggtggaagcactctacgaagcagccagccagtgtgaggccgagcctgagaagattctgggcctggctccagggggcttggaaatcctcctcagtctggtcagggctctcaaaagagtgaccaacaatgctgagaaggaaatggtcaaatcttgctttgagttttttgggatttcccaggtggatgccaagtattgccagatagctcagaatgaccctgggcccatattaagaataatttttgacctggatttgaacttgagagagaaaaaaacaaaagatcattttttgataatgactgaccaagtgaaattagccctaaacaaacaccttttgggcaggctgtgtcagatcacacggagcctgcttgggaagacctaccgaggagtctgcatgaggtttattgtaggcttaaaatgtgaggatgaaaactgtgaacattttcacaggcctctgcggcgttgtgaagccaagtgtttagttcagtcgaaaatgaacttggtggcaatcaacgggttgcttttggaagccaaaaaagtattccctaaaatcttagcagaagaacttaaagaaattgattatattttgtctacagatatgtatggcctttgcaagtccattctggatgtccttttccctaagcatttccatcagagagtgttgtcagaaaaccccatggcatgcaaagaaatcctcaaaccaaattacaaatccttccggttctacagatttgctttgaaggagtacatccactttctgtttgaaaatgaaagcgcacgcaaccgccgggaatccacagacctgtggctgagtgccatgcaagctttccttctctcttccaactacccggaggagtttgaaaagctgctccaccaggaggaggacaactacaacagggaactcaaagctctagagtctgaaaaggatgaaaggggcagggggagaggcagcaggataaaaggaatagaagggaaatttggcatgctggcacccaacagggatgatgaaaatatggacaagacccacctgtgcttcatccggcttctggagaattgcattgatcaattctacgtgtacaggaacccagaagactacaagaggctctttttccgtttcatgaatgtcctcatcaagaggtgcaaagaaccactcatccccagcattggaaacacagtagccctcctggagttccagttcatccactgtggggtggtgctggcccgcctctggaagaatgtcattctatgcctccccaagagctacattgcactcttgcactactgggagttcctgtttagcaagaaggacaaggagcttggggatgtgttctccatcattcaggaatacaaacccaaggacgtgacaagagccattcaggatttccggttccatctctcctacctcgccaaggtgctatgtggctatgagaatgtgaacttcaacgtcctgcttgatgccttcagtgaaatagactatgtggtctcgggtgaggctgagcggacactggtgctgtgcttggtgatgctagtgaatgctgaggagatcctgcagccatactgcaagcctctcctgtatcgccacttccgggagattgagtcaaggctgcagctcatgagcatggactgccctggccaggttcccgagaggctcctgaaggtggtgaagcgggtcttggtggcagtcaatgtgaagtctgtggctgaggcactgcaggacctgctctttgagcgggatgaagagtacctaatggactgtgactggcggtgggaccctgtgcacaccaaagggtccatagtccgtggcctctattatgaggaggtcagactaaaccgcctgctctgtttggaccctgtggactactttgctgaacctgagtgtgagtttggccaggatgagatggatgaactggcattagaagaccgagaccacgtcctggccaccattctttcccaaaagcaacggaaggcctccatacagcggaagttgaggagggcatgcctggtggtgtctctgtgcatcagttggaggagaagagtgggcacccagatggagcgtgtcagggaggaggccagggagcccagggctgggaacttcaaaaaggcagacgtggacaggacccagtgtgacctatgtggagtgaagtttacccgtggcccagagaactatttcagccccagcaaagcgtttgagggggcagcttccgaggtggcagtcctttccagggctgagctggaaagggaggagtgtcaggagaggaacagcgagtcttacgagcagcatatccatctagaacaccaccagaggcagcaagtggcctaccagaaatactcagaatttttccacgagaaggtggacccggccattgatgaaggcaagctggtggtgcaggacatcgagcaaagtgtatggatccacagtcacgtgggctccaaggagcacagccacatgctgcagaaggtccaggagcacatcaagagggtttcggatatggtggaggacctctacaggcggaaggcctgggctggcgcggaggaggcgatgactcggctggtcaacattctgatcctgtcagtcagggatgcacgagactggttgatgaaaacagagacccgcttaaagaaggaaggtattgttcaggaagatgattatgaaaatgaagttgaagactttggtgagcttcggcctagaaggcgttctcggaaatgtggaaagcagagaaaatactaatgtccacacagctgcagcctcctcatccttcggaacattccattctgacttagaattctgagcgctggggcagaagacaaaaagaatgtgaattagcattttaaaaataggggagtctaacaacaccattgctttttattctcattacttctctttcagtggcttaggatctgattgctccctcacctctaaagtgtttccaagtagagtctggcagtattagtttcccccacaaacaaattcaggtagagaagttgtagtcgaagggaatgttgggactcctcactgcatggtccctggggtgtctggctcatccccatcatgacatgagttggtagcagaggactaggtgttaggacagactctcctcacctcagttgctgctgctctgggccaggaaatctctctatggattccctcatctcctgccacactgctgcagcatcaagtgtgctatgagagctgtatgtgcccaggggtgggccctgccactggccaccccgagcccaggacgcattctggtcatctctgagcccacttgtagtgtagcttcttctgttagagatgttagccttttctctctgtggcgacttttctgccttcccttcttctgttttttgtgatcattcttagctacctgtgccaagtcacagttagactacctcagaatgtagtcaagaattcacccagtgttctttggatgtcccttccctagggggaaaggctggggaatgttgctgggagcattcccagctgcctctccaaagtggtcctaactctgccttggctatggtgcagacattccaaaaagtgttttgtatacagccctgtacatctagttttcttggttctccctggcaagttcgctaccctagcttaggctgacgttctgatgagtctctgcttgctgagctcatcactgtgggatggtgacctgcagagctgcagattggagcaagtggacagaggagggagccagctaagccaaatccgtcactgccacttggctggcaggccttataagagggcggatctgggcccgtttgcaggaggccattgcctaccctctccccacagtgagccagcagccatcagctgatcccacctgggaaaccttcatgcctctctgatggttactgcccacccttaccccacccctcagctcagcctggtatggaaagcaaggtgcacgttggtctttgattgttctgtcctcacagcagagccagctttccccccatgttgctgctgcttttgctgctcatgctgcttgttgttttctcttccttatctttccaaattgtttccttgaaatgcttgtttccaatttttcttagattatgtttctaatttttattccaggtgtttttttttcttacttgacagaaaaaaagaaaaccccaacaatatcttgctgtattatcacattttttataaagttaaagcatttctctt

SEQ ID NO: 190443 - DNA, 476 bp, Homo sapiens
  Payload ID: 17621
  Gene Name: tetratricopeptide repeat and ankyrin repeat containing 1
  ENST ID: ENST00000463764
  CDS Start-End: 66-476
agaccggaaggtgaacatgccctgcacgggtctggcagcaagcgtctcccccgtctcctcacaggatggacctgacagcttacgctgagctgctgaaagaatccggcaaccaggttcttaagaatgggaacttctctttggccatcagaaagtacgatgaagccatccagattctcctgcagttataccagtggggggttcccccgagggacttggctgtgctgctgtgcaacaaatcaaatgcatttttcagccttgggaagtggaatgaggcatttgttgctgccaaggaatgtctccaatgggatccaacctacgtgaagggatactaccgagctggttattccttgctgaggttgcaccagccttacgaagccgctcgcatgttttttgagggtctgcgacttgtgcagagaagccaagaccaggcaccggttgctgatttccttgttggagtcttcaccactatgagcagt

SEQ ID NO: 190444 - DNA, 1467 bp, Homo sapiens
  Payload ID: 17622
  Gene Name: tetratricopeptide repeat domain 1
  Uniprot ID: Q99614
  ENST ID: ENST00000231238
  CDS Start-End: 111-989
atcgacggaagtgcacctgactgagcggaagtaggagctctcagaggctaagaaggtggagaccggagaagctgtgaggttctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgctta

SEQ ID NO: 190445 - DNA, 543 bp, Homo sapiens
  Payload ID: 17622
  Gene Name: tetratricopeptide repeat domain 1
  ENST ID: ENST00000518560
  CDS Start-End: 1-492
gacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacga

SEQ ID NO: 190446 - DNA, 1432 bp, Homo sapiens
  Payload ID: 17622
  Gene Name: tetratricopeptide repeat domain 1
  Uniprot ID: Q99614
  ENST ID: ENST00000522793
  CDS Start-End: 108-986
atcgacggaagtgcacctgactgagcggaagtaggagctctcagaggctaagaaggtggagaccggagaagctgtgagctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacagaaaagaagagaagagagcactagactaaaggaggagggaaatgaacagtttaagaaaggagattatatagaagctgaaagttcttatagtcgagccctcgaaatgtgcccatcctgcttccaaaaggagaggtcgattctattttcaaatagagctgcagcaaggatgaaacaggacaagaaagaaatggccatcaatgactgcagcaaagcaattcaattaaaccccagctatatcagggcaatattgaggagagcagagttgtatgagaagacggacaagctagatgaagccctggaagactataaatctatattagaaaaagatccatcaatacatcaagcaagagaagcttgtatgagattacctaagcaaattgaagaacgtaatgaaagactaaaagaagagatgttaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatt

SEQ ID NO: 190447 - DNA, 2509 bp, Homo sapiens
  Payload ID: 17623
  Gene Name: tetratricopeptide repeat domain 12
  Uniprot ID: Q9H892
  ENST ID: ENST00000314756
  CDS Start-End: 20-2218
ttagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagagtgcctgccgagagcagtcatctccaatttggaagagagtctgctgcacctgaagctctgtctcctcgcaggtgggaagagatgtttcacatgctagtattctccctctccagtgtggatccacccccgccaccgccccaaacttgttacccctaacacatgctaccatgcagaccttccaggcagcatggaaaataccagcgccatctttcagaaggcctcatctccacttgccaggagccccgacaccacccttggagacacggcttgttccagatgaggaaactgaggtgcaaagcagttaagcaactggtccaagatctagaccaggtactcaaccaccccactccacatgcaactgtccccaacccatgcgattcatcctttccctgaaggcttgtgtggtgctgccttttaaattcataacataatgacttcattgttatg

SEQ ID NO: 190448 - DNA, 2541 bp, Homo sapiens
  Payload ID: 17623
  Gene Name: tetratricopeptide repeat domain 12
  ENST ID: ENST00000393020
  CDS Start-End: 406-2415
agtgcgtgcggcctggcctctttgcgcccggcgggcagcgcgcgtctggggcaggctccgcgcggggctcgggcacaggtccccgctgccgcagccctaccgagtgaagcactgagcgcggcgccgcttcgccatcacctggctctggccctctcaccctagcgtaggggggcactggccaggcagtgaggaccctgagatccatgccctgggagacagaggttgtctcctgtccatgcacccgcgcgcctgccttctaaccttcataccgttgggcagattaattcactggactaggcctctgttccgtgggagttgaaaagatttgacctggaagaaaccctagcgattattcagttaagccgcaaccccaccccctgttttatatagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaagagccccgacaccacccttggagacacggcttgttccaggtaatcagagtcttctggttcaacaagcagaggagctgggattttccatcctaaagaggatgtggccgggatggaactccatcaccatcctgaagccacagcagaggtggcagaattctctggggcctcatccaagtggctgtgtatatcagtagttgctgagtcctattccataatacagcactatggtgtgtttagccattcattggttgaaggacatctgagcggtttccagattttagctattgcaaataaagctgcaatgagcattcatatacaga

SEQ ID NO: 190449 - DNA, 764 bp, Homo sapiens
  Payload ID: 17623
  Gene Name: tetratricopeptide repeat domain 12
  ENST ID: ENST00000442859
  CDS Start-End: 159-764
ggtcactgcgccatttcctgtccaaagctgggcgaatcaggtccctaaatcgccggggttgatgttggctttggaagaactatttgcagagcgttttctgcactggaaggagggctggaagctttctggaagcattgccgcacggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaa

SEQ ID NO: 190450 - DNA, 830 bp, Homo sapiens
  Payload ID: 17623
  Gene Name: tetratricopeptide repeat domain 12
  ENST ID: ENST00000455306
  CDS Start-End: 329-830
gtctggggcaggctccgcgcggggctcgggcacaggtccccgctgccgcagccctaccgagtgaagcactgagcgcggcgccgcttcgccatcacctggctctggccctctcaccctagcgtaggggggcactggccaggcagtgaggaccctgagatccatgccctgggagacagaggttgtctcctgtccatgcacccgcgcgcctgccttctaaccttcataccgttgggcagattaattcactggactaggcctctgttccgtgggagttgaaaagatttgacctggaagaaaccctagcgattattcaggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctca

SEQ ID NO: 190451 - DNA, 669 bp, Homo sapiens
  Payload ID: 17623
  Gene Name: tetratricopeptide repeat domain 12
  ENST ID: ENST00000429951
  CDS Start-End: 348-669
ggtcactgcgccatttcctgtccaaagctgggcgaatcaggtccctaaatcgccggggttgatgttggctttggaagaactatttgcagagcgttttctgcactggaaggagggctggaagctttctggaagcattgccgcacgtaaatgagtgcctcttggcctaaaacagcagttggaatgaaagggatcaccctgctgttattcattgacataaacaaaactgtcataaaaataatcacttggctcttagttttagaaggctaataagcctgaccgttctgtttagtgctttattattattaatttcaccattatgctgcatcccttagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatg

SEQ ID NO: 190452 - DNA, 2240 bp, Homo sapiens
  Payload ID: 17623
  Gene Name: tetratricopeptide repeat domain 12
  ENST ID: ENST00000483239
  CDS Start-End: 18-2153
agggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtcattctcttttatgcagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatcca

SEQ ID NO: 190453 - DNA, 594 bp, Homo sapiens
  Payload ID: 17623
  Gene Name: tetratricopeptide repeat domain 12
  ENST ID: ENST00000529850
  CDS Start-End: 52-594
actgcgccatttcctgtccaaagctgggcgaatcagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccagtgtgatgaaaaatgcacaaaagcatattttcacatgggaaaagccaacctggccctgaagaactacagtgtgtctagagagtgttataagaagatctta

SEQ ID NO: 190454 - DNA, 558 bp, Homo sapiens
  Payload ID: 17623
  Gene Name: tetratricopeptide repeat domain 12
  ENST ID: ENST00000527362
  CDS Start-End: 1-253
gaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgaca

SEQ ID NO: 190455 - DNA, 2315 bp, Homo sapiens
  Payload ID: 17623
  Gene Name: tetratricopeptide repeat domain 12
  Uniprot ID: Q9H892
  ENST ID: ENST00000529221
  CDS Start-End: 106-2223
cttggtcccgccccgggcccctggctcctggccccgccccagcccaggcaggtcactgcgccatttcctgtccaaagctgggcgaatcagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatccacttca

SEQ ID NO: 190456 - DNA, 566 bp, Homo sapiens
  Payload ID: 17623
  Gene Name: tetratricopeptide repeat domain 12
  ENST ID: ENST00000531164
  CDS Start-End: 54-566
actgcgccatttcctgtccaaagctgggcgaatcagccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgt

SEQ ID NO: 190457 - DNA, 2520 bp, Homo sapiens
  Payload ID: 17623
  Gene Name: tetratricopeptide repeat domain 12
  Uniprot ID: Q9H892
  ENST ID: ENST00000494714
  CDS Start-End: 28-2226
tgggcgaatcagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagagtgcctgccgagagcagtcatctccaatttggaagagagtctgctgcacctgaagctctgtctcctcgcaggtgggaagagatgtttcacatgctagtattctccctctccagtgtggatccacccccgccaccgccccaaacttgttacccctaacacatgctaccatgcagaccttccaggcagcatggaaaataccagcgccatctttcagaaggcctcatctccacttgccaggagccccgacaccacccttggagacacggcttgttccagatgaggaaactgaggtgcaaagcagttaagcaactggtccaagatctagaccaggtactcaaccaccccactccacatgcaactgtccccaacccatgcgattcatcctttccctgaaggcttgtgtggtgctgccttttaaattcataacataatgacttcattgttatgaaa

SEQ ID NO: 190458 - DNA, 807 bp, Homo sapiens
  Payload ID: 17623
  Gene Name: tetratricopeptide repeat domain 12
  ENST ID: ENST00000525965
  CDS Start-End: 44-807
atttcctgtccaaagctgggcgaatcagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccagtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaag

SEQ ID NO: 190459 - DNA, 535 bp, Homo sapiens
  Payload ID: 17623
  Gene Name: tetratricopeptide repeat domain 12
  ENST ID: ENST00000462711
  CDS Start-End: 1-249
gaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagtgcctgccgagagcagtcatctccaatttggaagagagtctgctgcacctgaagctctgtctcctcgcaggtgggaagagatgtttcacatgctagtattctccctctccagtgtggatccacccccgccaccgccccaaacttgttacccctaacacatgctaccatgcagaccttccaggcagcatggaaaataccagcgccatctttcagaaggcctcatctccacttgccaggagccccgacaccacccttggagacacggcttgttccagttggttgaatctgcaaatttggaacccgagggtacagagggctgactgtatctgctttgttggagtccatctgattcattgtctaaatacaattaattgctccaaaa

SEQ ID NO: 190460 - DNA, 433 bp, Homo sapiens
  Payload ID: 17623
  Gene Name: tetratricopeptide repeat domain 12
  ENST ID: ENST00000524580
  CDS Start-End: 165-433
gcgcctgccttctaaccttcataccgttgggcagattaattcactggactaggcctctgttccgtgggagttgaaaagatttgacctggaagaaaccctagcgattattcagttaagccgcaaccccaccccctgttttatatagggattccggttcacaatggatgctgataaagagaaagatttgcagaaatttcttaaaaatgtggatgaaatcttctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctgg

SEQ ID NO: 190461 - DNA, 2985 bp, Homo sapiens
  Payload ID: 17623
  Gene Name: tetratricopeptide repeat domain 12
  ENST ID: ENST00000464224
  CDS Start-End: 615-1067
aaagctgggcgaatcaggtcggtgccgcggggtaccccggaatcccccctgggagctggtcctgcactggccttcagagccgagcagaggacgctgctttgggccccagagcatgggaaggtcttggctgcggtctgggacggctgcggtctgggacctgcatggagggcccgggacttgcggacgcctgggagcggttgctgggcaacagtgcgtgcggcctggcctctttgcgcccggcgggcagcgcgcgtctggggcaggctccgcgcggggctcgggcacaggtccccgctgccgcagccctaccgagtgaagcactgagcgcggcgccgcttcgccatcacctggctctggccctctcaccctagcgtaggggggcactggccaggcagtgaggaccctgagatccatgccctgggagacagaggttgtctcctgtccatgcacccgcgcgcctgccttctaaccttcataccgttgggcagattaattcactggactaggcctctgttccgtgggagttgaaaagatttgacctggaagaaaccctagcgattattcagttaagccgcaaccccaccccctgttttatatagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccagcagtggtaatggctgtccactgttgctagccctgcgattctgtagcatcccttgtcaggttccctaagccctgccttcaccgtggaagaggtccctgtattcaactctcctcagttgcccagtgcaagtgtgccatctgtttcctggcaggaccatgactgatccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatcc

SEQ ID NO: 190462 - DNA, 3253 bp, Homo sapiens
  Payload ID: 17624
  Gene Name: tetratricopeptide repeat domain 13
  Uniprot ID: Q8NBP0
  ENST ID: ENST00000366661
  CDS Start-End: 9-2591
gagggaagatggcacctgccggctgctgctgctgctgctgcttctggggcggcgctgtggccgccgcgggcgccgcccggcgtgtcctgctgctgctgctgctgggggtcctgtccgccgggctgcggccaggcgccctggccaccgagcactactcgccgctctccctgctcaagcaggagctgcagcaccggcagcagcaggaggccccggcgggcggcggcggctgcagcccgcagtccggggactggggggaccagtactctgccgagtgcggcgagtcatcctttttgaacttccatgactcagactgcgaacccaagggatcatcaccctgtgactccttgctttccctcaacactgagaagattctgagccaggccaagtctattgcagaacagaagagattcccgtttgccactgataatgacagcacaaatgaagagttagctattgcttatgtcttgattggcagtggtctgtatgatgaagcaatacggcatttttcaacaatgcttcaggaggagcctgatctggttagtgcaatttatggccgagggatagcctatggaaagaagggactacatgacattaagaatgctgagcttgctctgttcgaactgagccgagtaattaccttggaaccagatcgtccagaggtatttgagcagcgagcagaaattctgtcccctctgggacgaattaatgaagcagtgaatgacctcactaaagctatccaactgcagccctcagcacggctgtacagacatcggggaaccctgtacttcatatcagaggactatgcaacagcccatgaagactttcagcagtccttagaactgaacaaaaaccagcctatagctatgctatacaaaggtttaactttctttcacagaggacttctgaaggaagctattgaatccttcaaagaagctttgaagcagaaagttgactttattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctcagccatgttgccatgggacagttttatgaagggataaaagcacaaacaaaagttatgctgaatgatcctctcccaggccagaaggctagccctgagtatcttaaagtaaagtatctccgagagtattctcgatatcttcatgcacaccttgataccccccttacggaatataacattgatgtggatctgcctggaagctttaaggaccactgggctaaaaatttgcctttcctcatagaagactacgaagagcagccagggttgcaaccccacataaaagatgtgttacatcagaattttgagagttataagcctgaagtacaggagctgatttgtgtggctgatcgtttgggatccctgatgcaatatgaaacacctggtttcctgccaaacaagagaatacacagagctatgggtttggccgcattggaggtcatgcaagccgtgcagcgtacatggaccaactcgaaagttcgaatgaatgggaagacacggttgatgcagtggagagacatgtttgacattgcagttaaatggagaaggattgctgacccagaccagcccgtgctgtggttagatcaaatgccagcacgaagtcttagcagaggttttaacaaccacattaatttaatcaggggtcaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaagcagtttaatactaaaacgaaggatgggttcaccgtgaacacaaaagttcccagccttaaagaccaagggaaggaatatgatggattcacaatcacgattacaggagacaaagttggcaatatattattttctgtggaaactcaaaccacggaagaaaggacacaattatatcatgctgaaatagatgcactttataaagatttgacagcaaaaggaaaagtattgattctttcatcagaatttggggaggctgatgctgtctgcaacttaatcttatccttagtttattacttttataatttaatgccactctctcgaggatccagtgtaattgcttactcggtcatcgtgggagcactgatggcaagtggaaaagaagtagcaggaaaaattcccaaagggaagttagtcgactttgaagctatgacagcccctggttcagaggcctttagcaaagtcgccaaaagctggatgaacttgaaaagtatttcaccttcttataagactcttccatcagtatcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcggggggaaaaagctacttgacttggagggaaagcgtatgtattagccggcagcctgttggttcccacttataaagtcatataactccttccttacagtaaaaaaaattttcctcaacaactaaaatataatactgaagatgaacaaaaacaaaaccaaataggagtgtttgtattcctttagagatctggatatttttcaaagacttgctttttacgcacattgtgatagagcatcttttgttgactcacgtaacctccatgtgtgggtcctttgttttattagaaccatggaagaaggttcctgggccatcagtatgtgttgcagagctcacagccaggaacacttattttgaacaatgcagacagtacttgccagagtcccaaatgctgaattattgaaccatgtttttttttcctttgttgaaaaaaataaaccagggtgatttctataaatcaccagtttttggcattgga

SEQ ID NO: 190463 - DNA, 3112 bp, Homo sapiens
  Payload ID: 17624
  Gene Name: tetratricopeptide repeat domain 13
  Uniprot ID: Q8NBP0
  ENST ID: ENST00000366662
  CDS Start-End: 30-2450
gggctgtcgcgcatgcgccttgagggaagatggcacctgccggctgctgctgctgctgctgcttctggggcggcgctgtggccgccgcgggcgccgcccggcgtgtcctgctgctgctgctgctgggggtcctgtccgccgggctgcggccaggcgccctggccaccgagcactactcgccgctctccctgctcaagcaggagctgcagcaccggcagcagcaggaggccccggcgggcggcggcggctgcagcccgcagtccggggactggggggaccagtactctgccgagtgcggcgagtcatcctttttgaacttccatgactcagactgcgaacccaagggatcatcaccctgtgactccttgctttccctcaacactgagaagattctgagccaggccaagtctattgcagaacagaagagattcccgtttgccactgataatgacagcacaaatgaagagttagctattgcttatgtcttgattggcagtggtctgtatgatgaagcaatacggcatttttcaacaatgcttcagattctgtcccctctgggacgaattaatgaagcagtgaatgacctcactaaagctatccaactgcagccctcagcacggctgtacagacatcggggaaccctgtacttcatatcagaggactatgcaacagcccatgaagactttcagcagtccttagaactgaacaaaaaccagcctatagctatgctatacaaaggtttaactttctttcacagaggacttctgaaggaagctattgaatccttcaaagaagctttgaagcagaaagttgactttattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctcagccatgttgccatgggacagttttatgaagggataaaagcacaaacaaaagttatgctgaatgatcctctcccaggccagaaggctagccctgagtatcttaaagtaaagtatctccgagagtattctcgatatcttcatgcacaccttgataccccccttacggaatataacattgatgtggatctgcctggaagctttaaggaccactgggctaaaaatttgcctttcctcatagaagactacgaagagcagccagggttgcaaccccacataaaagatgtgttacatcagaattttgagagttataagcctgaagtacaggagctgatttgtgtggctgatcgtttgggatccctgatgcaatatgaaacacctggtttcctgccaaacaagagaatacacagagctatgggtttggccgcattggaggtcatgcaagccgtgcagcgtacatggaccaactcgaaagttcgaatgaatgggaagacacggttgatgcagtggagagacatgtttgacattgcagttaaatggagaaggattgctgacccagaccagcccgtgctgtggttagatcaaatgccagcacgaagtcttagcagaggttttaacaaccacattaatttaatcaggggtcaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaagtttaatactaaaacgaaggatgggttcaccgtgaacacaaaagttcccagccttaaagaccaagggaaggaatatgatggattcacaatcacgattacaggagacaaagttggcaatatattattttctgtggaaactcaaaccacggaagaaaggacacaattatatcatgctgaaatagatgcactttataaagatttgacagcaaaaggaaaagtattgattctttcatcagaatttggggaggctgatgctgtctgcaacttaatcttatccttagtttattacttttataatttaatgccactctctcgaggatccagtgtaattgcttactcggtcatcgtgggagcactgatggcaagtggaaaagaagtagcaggaaaaattcccaaagggaagttagtcgactttgaagctatgacagcccctggttcagaggcctttagcaaagtcgccaaaagctggatgaacttgaaaagtatttcaccttcttataagactcttccatcagtatcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcggggggaaaaagctacttgacttggagggaaagcgtatgtattagccggcagcctgttggttcccacttataaagtcatataactccttccttacagtaaaaaaaattttcctcaacaactaaaatataatactgaagatgaacaaaaacaaaaccaaataggagtgtttgtattcctttagagatctggatatttttcaaagacttgctttttacgcacattgtgatagagcatcttttgttgactcacgtaacctccatgtgtgggtcctttgttttattagaaccatggaagaaggttcctgggccatcagtatgtgttgcagagctcacagccaggaacacttattttgaacaatgcagacagtacttgccagagtcccaaatgctgaattattgaaccatgtttttttttcctttgttgaaaaaaataaaccagggtgatttctataaatcaccagtttttggcattgga

SEQ ID NO: 190464 - DNA, 492 bp, Homo sapiens
  Payload ID: 17624
  Gene Name: tetratricopeptide repeat domain 13
  ENST ID: ENST00000486879
  CDS Start-End: 1-372
gacattgcagttaaatggagaaggattgctgacccagaccagcccgtgctgtggttagatcaaatgccagcacgaagtcttagcagaggttttaacaaccacattaatttaatcaggggtcaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaaggtaactttagcatcagaatggcagtccatgtttttagaggaaaagaaaaccaacagcacttttttaaaaagaactcagaattattaaatgctatttgaaatcactcgtatgaacacattctgaataataaccaaaataaaagaacctacaggcatcagactcaaacagaaaaaacaacttgtgaggaagcagttaatatagaaaaaa

SEQ ID NO: 190465 - DNA, 529 bp, Homo sapiens
  Payload ID: 17624
  Gene Name: tetratricopeptide repeat domain 13
  ENST ID: ENST00000522399
  CDS Start-End: 32-529
aagggctgtcgcgcatgcgccttgagggaagatggcacctgccggctgctgctgctgctgctgcttctggggcggcgctgtggccgccgcgggcgccgcccggcgtgtcctgctgctgctgctgctgggggtcctgtccgccgggctgcggccaggcgccctggccaccgagcactactcgccgctctccctgctcaagcaggagctgcagcaccggcagcagcaggaggccccggcgggcggcggcggctgcagcccgcagtccggggactggggggaccagtactctgccgagtgcggcgctattgcttatgtcttgattggcagtggtctgtatgatgaagcaatacggcatttttcaacaatgcttcagattctgtcccctctgggacgaattaatgaagcagtgaatgacctcactaaagctatccaactgcagccctcagcacggctgtacagacatcggggaaccctgtacttcatatcagaggactatgcaacagcccatgaagactttcagcagtcctta

SEQ ID NO: 190466 - DNA, 1062 bp, Homo sapiens
  Payload ID: 17624
  Gene Name: tetratricopeptide repeat domain 13
  ENST ID: ENST00000481976
  CDS Start-End: 46-813
cctgagagccgggcaagggctgtcgcgcatgcgccttgagggaagatggcacctgccggctgctgctgctgctgctgcttctggggcggcgctgtggccgccgcgggcgccgcccggcgtgtcctgctgctgctgctgctgggggtcctgtccgccgggctgcggccaggcgccctggccaccgagcactactcgccgctctccctgctcaagcaggagctgcagcaccggcagcagcaggaggccccggcgggcggcggcggctgcagcccgcagtccggggactggggggaccagtactctgccgagtgcggcgagtcatcctttttgaacttccatgactcagactgcgaacccaagggatcatcaccctgtgactccttgctttccctcaacactgagaagattctgagccaggccaagtctattgcagaacagaagagattcccgtttgccactgataatgacagcacaaatgaagagttagctattgcttatgtcttgattggcagtggtctgtatgatgaagcaatacggcatttttcaacaatgcttcagattctgtcccctctgggacgaattaatgaagcagtgaatgacctcactaaagctatccaactgcagccctcagcacggctgtacagacatcggggaaccctgtacttcatatcagagaatgaggtagagagctgtgcagtgattagacaggaaccccgaaaccaaagactcttaaaagctgaagagaaatcagactttgaagaactgtggcgtccaagcatgctgaagctattgaatccttcaaagaagctttgaagcagaaagttgactttattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctca

SEQ ID NO: 190467 - DNA, 558 bp, Homo sapiens
  Payload ID: 17624
  Gene Name: tetratricopeptide repeat domain 13
  ENST ID: ENST00000522821
  CDS Start-End: 1-558
tctggggcggcgctgtggccgccgcgggcgccgcccggcgtgtcctgctgctgctgctgctgggggtcctgtccgccgggctgcggccaggcgccctggccaccgagcactactcgccgctctccctgctcaagcaggagctgcagcaccggcagcagcaggaggccccggcgggcggcggcggctgcagcccgcagtccggggactggggggaccagtactctgccgagtgcggcgagtcatcctttttgaacttccatgactcagactgcgaacccaagggatcatcaccctgtgactccttgctttccctcaacactgagaagattctgagccaggccaagtctattgcagaacagaagagattcccgtttgccactgataatgacagcacaaatgaagagttagctattgcttatgtcttgattggcagtggtctgtatgatgaagcaatacggcatttttcaacaatgcttcaggaagctattgaatccttcaaagaagctttgaagcagaaagttgactttattgatgcatataaaagtctagggcaggcat

SEQ ID NO: 190468 - DNA, 865 bp, Homo sapiens
  Payload ID: 17624
  Gene Name: tetratricopeptide repeat domain 13
  ENST ID: ENST00000466507
  CDS Start-End: 6-458
ggaagatggcacctgccggctgctgctgctgctgctgcttctggggcggcgctgtggccgccgcgggcgccgcccggcgtgtcctgctgctgctgctgctgggggtcctgtccgccgggctgcggccaggcgccctggccaccgagcactactcgccgctctccctgctcaagcaggagctgcagcaccggcagcagcaggaggccccggcgggcggcggcggctgcagcccgcagtccggggactggggggaccagtactctgccgagtgcggcgagtcatcctttttgaacttccatgactcagactgcgaacccaagggatcatcaccctgtgactccttgctttccctcaacactgagaagattctgagccaggccaagtctattgcagaacagaagagattcccgtttgccactgataatgacagcacaaatgaagagttagatatttactgattatgggataataaataggaaataaaaatttagatttgaaaggaaactttaagaaaattttctacaggcttattaagcaagaccagacagttatgagaagtgactgaggtccccacgatcacacggctgctattgcttatgtcttgattggcagtggtctgtatgatgaagcaatacggcatttttcaacaatgcttcaggaggagcctgatctggttagtgcaatttatggccgagggatagcctatggaaagaagggactacatgacattaagaatgctgagcttgctctgttcgaactgagccgagtaattaccttggaaccagatcgtccagaggtatttgagcagcgagcagaaattctgtcccctctgggacgaattaatgaagcagtgaatgacctcact

SEQ ID NO: 190469 - DNA, 2881 bp, Homo sapiens
  Payload ID: 17625
  Gene Name: tetratricopeptide repeat domain 14
  Uniprot ID: Q96N46
  ENST ID: ENST00000296015
  CDS Start-End: 133-2445
ggttgtgctgtctgtgtacttccggcagcctccagacagtttcttccgcttcctgtaccacccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcagaaatctttggaattaagagaaaaacaagctgaaaaggaagaaaagcagaaaacaaagaaaatagaaacaagtgcagaaaagttgcgtaagctcttaaaagaagagaagaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagatt

SEQ ID NO: 190470 - DNA, 2274 bp, Homo sapiens
  Payload ID: 17625
  Gene Name: tetratricopeptide repeat domain 14
  Uniprot ID: Q96N46
  ENST ID: ENST00000382584
  CDS Start-End: 52-2013
ggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcagaaatctttggaattaagagaaaaacaagctgaaaaggaagaaaagcagaaaacaaagaaaatagaaacaagtgcagaaaagttgcgtaagctcttaaaagaagagaagaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggagtgtactcctatttatttaaaaagttaactataaaacagcctcaggcaggtccttcaggagatattccagaagagggcattgttatcatagatgacagctccattcatgttactgaccctgaagaccttcaagtgggacaagatatggaggtggaagacagtggtattgatgatcctgaccacgggtaggcttaggtttatgtgtgtgtatgtgtcttagtttttaacaaaaaaattaaaaagtaaaaaaactaaaaatagaaaaatgcttagagaataaggatataaagaatatttttgtgcagttgaacaatgagtgcttaagctaaatgtcatcacaaaagagtaaaaaaattttacaaaattaaaaatgtttaaagttaaaaagctctaggaagctaaggtcaatttattattggagaaataaaattatttttatgaatttactgt

SEQ ID NO: 190471 - DNA, 4568 bp, Homo sapiens
  Payload ID: 17625
  Gene Name: tetratricopeptide repeat domain 14
  Uniprot ID: Q96N46
  ENST ID: ENST00000412756
  CDS Start-End: 70-1389
ggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaa

SEQ ID NO: 190472 - DNA, 706 bp, Homo sapiens
  Payload ID: 17625
  Gene Name: tetratricopeptide repeat domain 14
  ENST ID: ENST00000495660
  CDS Start-End: 306-706
tgggtggacggggggcgctcctgggttgtgcaatgcgggatgcgggctgaactttttctctggcactgcttggtagaggcgcagattccttagctaaaaatcccttgagctttcctatctgagttggaggcgtcactttttaagtttccccgctctccacctccagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacag

SEQ ID NO: 190473 - DNA, 741 bp, Homo sapiens
  Payload ID: 17625
  Gene Name: tetratricopeptide repeat domain 14
  ENST ID: ENST00000492617
  CDS Start-End: 185-741
gaggaagtggagccgcggccgtgagcacaggacgatcgcgcgctgaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaag

SEQ ID NO: 190474 - DNA, 3150 bp, Homo sapiens
  Payload ID: 17625
  Gene Name: tetratricopeptide repeat domain 14
  Uniprot ID: Q96N46
  ENST ID: ENST00000470669
  CDS Start-End: 52-1371
ggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgagctggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaagcaaaaatttctctgaagatgattttgcttctgcattgagaaaaaaacaatccgcatcttgggctttaaaatgtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatgaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggag

SEQ ID NO: 190475 - DNA, 836 bp, Homo sapiens
  Payload ID: 17625
  Gene Name: tetratricopeptide repeat domain 14
  ENST ID: ENST00000462895
  CDS Start-End: 46-624
gggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagctctttgtcccttaagagatgtgccttctcacagtaaccatggggatcctttatcatattaccaaactggtgacatcattcgaggtgattagtttcatcatactaataaaaaactggaatcaaggatattgacagataccatgaaaagctagcagtatctctgtatagctcttctcttccaccacacctatctggtattaaattaggtgtaattagctctgaagagcttcctttatactacaggagaagtgttgagctaaatagcaattctttggagtcctatgaaaatgtcatgcagagttcc

SEQ ID NO: 190476 - DNA, 601 bp, Homo sapiens
  Payload ID: 17625
  Gene Name: tetratricopeptide repeat domain 14
  ENST ID: ENST00000491380
  CDS Start-End: 74-601
acccggctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagttgttcaactactagctgtttcataccaaacaactaagata

SEQ ID NO: 190477 - DNA, 7052 bp, Homo sapiens
  Payload ID: 17625
  Gene Name: tetratricopeptide repeat domain 14
  ENST ID: ENST00000465065
  CDS Start-End: 68-595
ctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgtggtgatatagtgattggaagaattagttctattcgggaattcggttttttcatggtgttgatctgtttaggaagtggtatcatgagagatatagcccacttagaaatcacagtaagttatttttgttacttggattgcttctgtttttgttaacgcatctcaatgcaagaactatatctttgcatgcagttgtgctcaagtatacctgccaagatgcttttggaaattaaatgttaattggagaaaaatagtttaaaaaaattagtgtaagttacccagtttctccctccatttctggtttttgggattttttaaatttaaactggttggcaggcacagtgttcttttctaaatgctcaaagaggtatcagtggacgtggtgaggttgattgatattcagacttatttcttgtagttgaacatatgtattcttaattagttaatatttggcattgtatattttcatgtggataatttggagagaagtttcatttatatatttacaataattaaatgtaagtggtttgtacattatattaagatactttgcccaagatggatagtcctgaatttaaactaatgtgtcacgataaaagattgggtatttgccatctatccaggcagataaaaaggaagaaaagcagaaggtattacagattggataacagacaaaatactttggagaattggcatttcattttcactggaatccttataccttttagacaaattttagtttgtttttgatgcatgttgtatactgtcataagccatcatatttggttcctaaactaatggaaagtttcatgagattttagttttttaactgaaccagcaaacatattttactgtgtttggacacggaaattacttttaactaaatccttatttaaatttttactttaggttgttcaactactagctgtttcataccaaacaactaagataaaagaagacactgttcttatcaaagcttgaaatgtctggtgttttaaaatacttctcattacaggctctttgtcccttaagagatgtgccttctcacagtaaccatggggatcctttatcatattaccaaactggtgacatcattcgaggtgattagtttcatcatactaataaaaaagtaatgattgttgaatttttgtttttattaatttaaaaaaatacagtctaagagggtagtgtttgggaaagtttatattttttatgttagtttacattttcttactaatcagcttagttctctttttttttttcttaagctggaatcaaggatattgacagataccatgaaaagctagcagtatctctgtatagctcttctcttccaccacacctatctggtattaaattaggtgtaattagctctgaagagcttcctttatactacaggtaatttatccgtattatttcaacaacagttcattacaaaagtctcttggattgaggaataccacatttttataacggttaaattacttcagacttggtaaaaggaaaccatatcataatattgccacaccatcttatgcaaaaaatggaattagtatttaaacctcaaatgatattatttctttactagaaatggaatgtcaaattagtcattttacaatttttgtgtttgtatttttttaaggagaagtgttgagctaaatagcaattctttggagtcctatgaaaatgtcatgcagagttccttgggatttgttaatccaggagtagttgaattccttctagaaaaactaggaatagatgaatctaatccaccatctttaatgagaggcctacaaaggtatagtacatcagtattactcttagatggtgaggggagtggcagtaagctcagaagctgcgtttagctgaaggacgtattttaccatcctaagccacctagtagcaggcatatgccaaaggttgaatgaaccaggtgatcccatcttctggactggactgtcttatcagtgattaatatgtgtaccatgtaaccaagtagagaaggatgcagaaactttttataagaattttgtgtgtatgctaaagaaaaatactgggtttttttgttttttgtttttgttttttgagtcggagtctcactgtgtcacccaggctggagtgcagtggcgctatctcagctcactgcaagctctgcccctgggttcacgccattctcctgcctcagcctcccaagtagctgggactacaggtgcccgccaccacgcctggctaatttttttttctttgatttttagtagagttggggtttcaccgtgttagccaggatggtctcaatctcctgacctcgtgatccacccgcctcgacctcccaaagtgttgggattacaggcgtgagccaccgcacctggccaagaaaaatactgtttaacaataataatcatttcgaaagttcaaagattttggtatgtaaatagaatgcagatttcttgcttgggattcatactttcactgtcgagtgcctgtcaagcagagttaagtatagttacttaaaaaatatttgtggtttaactttttaatttttattttctttaatagcaaaaatttctctgaagatgattttgcttctgcattgagaaaaaaacaatccgcatcttgggctttaaaatggtatgaagactgtctttcaacaattgcattatatctagtctaaaagcttagggcaaggcaagcatgcttatatcatcaataagacaaatttgagatgcattaaagtgatgcctttttgacatgagcttttcttttatagatgtaagtagtcttacattttacacttaacagataagttttactcagcatttcagttttctcaaaaggaattagtatattgatatctaggtttcaccaatatttgttgtgaaaatgtccaaaggcagaagaacgttccttaggtatattgtgagtactctgaaaactaaatattttgccaagtttgatgacatttgcttttaaaacttattcacactaacattttatttagatattgtttgaagtgtttgtgatgctttacaaatgtcttttttagtgtgaagatcggagttgactattttaaagttggacgccatgtggatgctatgaatgaatacaataaagctttggaaatagacaaacaaaacgtggaagctttggtagctcgtggagcattatatgcgacaaaaggaagtttgaacaaagcaatagaagattttgagcttgcattagaaaactgtccaactcacagaaatgcaagaaaatacctctgccagacacttgtagagagaggaggacagttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaa

SEQ ID NO: 190478 - DNA, 2897 bp, Homo sapiens
  Payload ID: 17626
  Gene Name: tetratricopeptide repeat domain 16
  Uniprot ID: Q8NEE8
  ENST ID: ENST00000373289
  CDS Start-End: 81-2702
ggtgatggtgcctagcaacgtcagggccagggccgcgaggtagttggcagaggcctcggggtcctcctggaaggggcctcatgacagattcggacgaggatgccctgaaggttgaccagggcccctcacgggacatcccaaagccatgggtgattccagcccccaaagggatcctgcagcacatctttgggaccagccacgtgttccaaagcatctgtgatgtaaaaccaaaggtcacagggttaacagtgcccctcaaagtcagggaatactactccagaggccagcagtgcttggagcaggcagactgggagacagctgtgctgctcttctcccgcgcactccacctggacccacagctggtggacttctatgccttacgggctgaggcctacctccagctctgtgacttctcctcggccgcccagaacctgcgaagggcctactcattacagcaggacaactgcaagcacctggagcgcctcacctttgtgctctacctacagggacaatgcctttttgagcagtgtgccttcctggatgccctgaatgtcttctcacatgctgctgagctccagcctgagaaaccatgcttccgttaccgatgcatggcctgtctcctggccctcaagcagcatcaggcctgcctcacgctcatcaccaacgagctgaagcaggacaccaccaacgccgatgtctacatcttccgggccagactctacaactttctccagaagccccacctctgctaccgggacctgcacagcgccttgctgttgaatcccaagcacccgcaggccaggatgctgctccagaagatggtggcccaggcccagcaggcgcgccaagatgcggggatcctggctgtgcagggcaagctgcagcacgcactgcagcggatcaaccgtgccatcgagaacaaccctctggaccccagtctcttcctcttccggggcaccatgtaccgacggctccaggagttcgatggggcagtggaggacttcctgaaggtgctggacatggtgaccgaggaccaggaggacatggtgcggcaggcacagcgccagctgttgctgacctacaacgactttgccgtgcactgctacaggcagggcgcctaccaggagggcgtgctgctgctgaacaaggccctccgggacgagcagcaggagaaaggactctacatcaaccgaggcgattgcttcttccagctgggcaacctggcctttgccgaggcggactaccagcaggcgctggcgctgagccctcaggacgagggcgccaacacgcgcatgggcctgctgcaggagaagatgggcttctgcgagcagaggcgcaagcagttccagaaggcagagaaccacttctccacggccatccggcacaacccccagaaggcccagtactacctgtaccgggccaagagccggcagctgctgcagaacatttttggggcccgccaggatgtggccactgtcctgctcctcaaccccaagcaaccaaagctgtccctgctgatgaccaacctcttcccgggcatgtcggtggaggaggtgcttagcacccagatagcccacctggccaggctgcagctggagcagatggtggagggcagcctgcaggccggcagcccacaaggcattgtggggatgcttaaacggcacgagttggagcgccagaaggccttggccctgcagcactcatggaagcagggggagcctttgattgcgacctccgaggagctgaaggccacccctgagattccgcaggtaaaaccgggaagctcagagggagaggctgaggcccctgaggaggaggaagaaaaggagaaggagaaaaaagaggagaaaaaatcagagctcatacctagcaaggtggcgtccctgtctgacagctaccttgaccagacctcttcagcctccagcatgagcttcaggaccacaggcacctcagagactgagatgtcggctatctgccaggaatacaggagcacctcagccaccgccgtgacattctctgactcgtcactgttgaagacgcaatcctcggactctgggaacaacagggaggcactaagccatggtcccagaaaaatcaaggccacccagggccagaggcagagccttagcaagactgagcccacccagagccagaggcggaactccagcaagaccaaggccactatacacaagaggaactccagcaagaccaaggccacccaaagccagaggcggaactccagcaagaccagggccacccagggccaggggcagagctccagcaagactgaggccactcagggccagaggcagagctccagcgagattgaggccacccagggcccaaggcaggagcccagcaagaccaagaccacccggagcccaaggcagaggcccagaaaggtcaaggctgctcgtggccggagctggagacccagcaaggttgatgccacccagggccgaagcaggggactgctccgaagttccaccaagactgaggctttctatgactcaaactggagcctcagcaaaactgagtatgcccaaggccagggccagaggtccagcaaggctgagggtgcccagggcaagagccagggcatgagctcaacttccagcaaggccgagtccacctggggacccagcccaagtctcagcaaaactgaggttgatcaggacctcacctactatgaagctgtctgaagggaccatccagaccctcccttcttgctggggaggggacgagttctacccacctccccacactggcactcagccagctgcctccttccagagcaattaaaagtcttagcaacagtcctctggtcccacagctgagtttattatacttgttttcttttacaaaattaaaaacatctaaaaccaggcccaagtggc

SEQ ID NO: 190479 - DNA, 4469 bp, Homo sapiens
  Payload ID: 17627
  Gene Name: tetratricopeptide repeat domain 17
  Uniprot ID: Q96AE7
  ENST ID: ENST00000039989
  CDS Start-End: 15-3440
gccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaaggaaaaaaacgtgactaccagcgtctgggatggcccagcccggacgaatgcctcaaactccgctgggtagagctgactgccatcgtgagtacctggcttgcagtttcttcaaaaaacattgacatcacagaacacatagattttgccacccctatacagcagccagcaatggagcctctttgcaatggcaatctccccacgagtatgcataccctggaccacttgcatggggtttccaaccgagccagcctgcactacacaggggagagtcagttaacagaggtattacaaaatctcggcaaagaccaatatccacaacagtcgcttgaacagattggcacccgaattgccaaagttttggaaaagaaccagacgtcctgggtcctctccagcatggcagccctctactggagggtgaaaggccaaggaaagaaggcaatcgactgcctccgccaggctctgcactatgcgccacaccagatgaaggatgtgcccctgattagcctggccaacatcttgcacaatgccaagctctggaatgacgccgtcatagtagccaccatggcagtagagatcgcaccacactttgctgtgaaccacttcactctgggcaatgtctacgtggcaatggaagaatttgaaaaagcactggtgtggtatgaatccacattgaagcttcagcccgagtttgtcccagccaagaaccgaatccagaccatccagtgtcacttaatgctgaagaagggacggcgctctccttagtgcacttcttccttctctctttctctttactcatgctctaaaaaaaaagaataagaaaagaaaccaatcattgtcagtatctactattaatgatgtgtgtgaaaataactaagacttataacaggacttttacatatgtgggaattggtttgtttttgtttttacgtttctcctttcccccaaccaacctcagaagaggcaccttcagaaacacacatttcttaaaaggaaagtgcagcttcaagatattgtgtaaatactgagccaagacatttctggagctgtgctctgtctccaaaaacctcaatgcctttagggcttttctcagtggtccagctagccttctctttggaggaggatgaagccgcattgcacattctctgcttcctgtcgtagcctctgttgtcaatggaaatgcggaagcccatctggtgcccgtcagtgagaagcaacgttctgcgctctctccgttagacctccatgctgtccccagtcttgtccattccatgctgctgtgttacaaactctcagaggtagtttgcaggggaggaaggggaatatgattttaaaaacaaaatatttacaacaacaaaaattcttaggatcacctgacctttgtaatgttatttatgttggggagggaggggggctgagaaggggaaatcagcagtgtgcaacatctttataatttgtactttaattacaaatcacaaggaaaccaataagttgaaatcctatataacaggtttatatatatagaatatgtatatttgaagccctctacagactgagtctatgttttactaattctttgttcactgtgttacccatcttggaataagttgtgaatgtcagctccctctctctgaggcctccagacttagctcctcaggagggtaatgagccaaggttgagtgtttccatacaatgcttttacctttgatcccaggagaatcagaaactccaacattttggaatcttcaagggcacatactgagaaaaaaaataaaattgtttatgagcaaaata

SEQ ID NO: 190480 - DNA, 3648 bp, Homo sapiens
  Payload ID: 17627
  Gene Name: tetratricopeptide repeat domain 17
  Uniprot ID: Q96AE7
  ENST ID: ENST00000299240
  CDS Start-End: 24-2894
agcggcccggccgggggggcaagatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaagacccaatcttcacatatttatctaaacggttaggaaggagtatagatgacataggtcacctcattcatgaaggcctacagaagaacacttcctcgtgggtactgtataacatggcttcattttactggagaattaagaatgagccatatcaggtagtagaatgtgccatgcgagcacttcacttctcttccaggcacaataaagacattgccctggtcaacctggcaaacgttctacacagagcacacttctctgctgatgctgctgtcgtggtccatgcagctctggatgacagtgacttcttcaccagctattacactttggggaatatatatgcaatgcttggggaatataaccactcagtgctctgttatgaccacgctttgcaggccagacctgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcagtttggtgaggattcatcaacctccagtatgatgtctgtgaactttgatgttcaatcaaatcagagtgatatcaatgattcggtcaagtcttctcccgtagcccattctattctctggatttggggcagggactctgatgcatatagggacaaacagcatattctatggcctaaaagagcagattgtacagaaagctaccctagagtccctgttggtggggaattgccaacgtattttctgcctccggaaaacaaaggactcaggatccacgaactcagcagtgatgattattctacagaagaagaggcccaaacccctgactgttccataactgacttcagaaaaagccacactctgtcctacttagtcaaagaattagaggttcgcatggatctgaaagccaaaatgccagatgaccatgcacgaaaaattttgctttcccgtattaataactatactatcccagaagaagaaattgggtctttcttatttcatgctattaataagccaaatgctcctatctggctcatactcaatgaagctggactatactggagagcagtaggaaatagcacttttgctattgcctgtcttcagagggctttgaatttagctccacttcaataccaagatgttcctcttgtcaacttggccaaccttttgattcattacggccttcatcttgatgccactaagctgctacttcaagctttggccatcaatagctctgagcctctgacctttttgagcctgggaaatgcttaccttgctctgaagaatatcagtggggcacttgaggcctttagacaggccttgaaattaaccaccaaatgtccagagtgtgaaaacagcctgaagttgatccgctgtatgcagttttatccttttctgtacaacatcacttcttctgtttgcagtggtaattgtcatgagaaaaccctggacaacagccatgacaaacagaaatattttgacaactcacagtcactggatgctgctgaagaagagccctctgagagaggaacagaggaggaccctgtattctctgttgagaattcagggagggactcagatgcccttagacttgaaagtacggtggttgaggagagcaatggttctgatgagatggagaattcagatgaaaccaaaatgtcagaagaaatactggctttggtggatgaatttcaacaggcatggcctttggaaggctttgggggtgcactagagatgaaagggcggcgtctagacttacaaggaatacgggtgctgaagaaaggtccccaggatggagtggccagaagctcttgctatggagactgcagaagtgaagatgatgaagcaacagaatggattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaagggctactagactggaagaccaggaaagtgccatagacataatgtaactggatttcagcaaggcatttaacagagcctcttatgatatccttgtgaaccagatggagagatgtgggcttgaagccttcccattgcctacaggataaaattcaaacttcctagtgtggtgtacaagaccctttacagcccgcctctgtgtacccttcaacaccattctctgaaccaaccatgctcatgtttttacctcagtgcctttgcacatgctattccctctgcctggaatgccctgtgccccctctgccctctgccgtgctaaaatatcactcatccttaaacttcaaaatcaagtgccatctcttccttgttaccttcaggcagaattagttactctttcctctgtgcaattgttctatatcttcgctctagctcttttcctgttgtattgtaatgatttgtttatgtttaccttccttactagactgtgagctcaagagcaggccgtcttaattattcctttctgtacccctagtgtcttttatggttctcagccccttataacaggtgctcaataaatatttttcaaatgaaattattaaatgtaaaagaaaattaagattttttgtgaaaattatggcttatttaagttattaatttaaacagagttaatttgaaactcttccaaaactgttcctttctgttttgttaaaatctcaatctaaacccctgcctgtacctcaaacagttttctactgttcgtaaattcctataatataaaaagcgctatacagaa

SEQ ID NO: 190481 - DNA, 575 bp, Homo sapiens
  Payload ID: 17627
  Gene Name: tetratricopeptide repeat domain 17
  ENST ID: ENST00000418561
  CDS Start-End: 1-518
aggtattacaaaatctcggcaaagaccaatatccacaacagtcgcttgaacagattggcacccgaattgccaaagttttggaaaaggcatccaccgcgggtcttggaatgtatccctatcagaaccagacgtcctgggtcctctccagcatggcagccctctactggagggtgaaaggccaaggaaagaaggcaatcgactgcctccgccaggctctgcactatgcgccacaccagatgaaggatgtgcccctgattagcctggccaacatcttgcacaatgccaagctctggaatgacgccgtcatagtagccaccatggcagtagagatcgcaccacactttgctgtgaaccacttcactctgggcaatgtctacgtggcaatggaagaatttgaaaaagcactggtgtggtatgaatccacattgaagcttcagcccgagtttgtcccagccaagaaccgaatccagaccatccagtgtcacttaatgctgaagaagggacggcgctctccttagtgcacttcttccttctctctttctctttactcatgctctaaaaaaaaagaataagaa

SEQ ID NO: 190482 - DNA, 889 bp, Homo sapiens
  Payload ID: 17627
  Gene Name: tetratricopeptide repeat domain 17
  ENST ID: ENST00000534347
  CDS Start-End: 2-166
gatggcggcggcagtaggggttcgtggccggtacgagctgccgccttgctccggcccaggctggctcctcagcctttccgccttgctgagtgtggcggcacgaggggccttcgccaccacgcactgggtcgtcacggaggacgggaaaatccagcagcagttatagccaggagcccatgcgtatctctctcaagagtggaagctgggctgctatttttgcgaacctgtacttctctaaacctcaaagaagatgtaagcccatgatggttagacttgaatcctgaagagataattccatgagaagtggagcaacagactttctgcctgcgtcattccatccctgtgaaactcatcttgcttgctaccatagtagcctggaagggatcgcaaacagaagggtctcttagacaatcatttgattgtttgagctagatttgtgataagggtaaaaatctgagggaagaaaggtggattcaccaatgaacttgaagcatcctcatgacctagtcatattaatgagacaagaagcaacagttaactacctcaaagaattagagaaacaattagttgctcaaaaaattcacatagaagagaatgaggacagagacacaggactggaacagagacataataaagaagacccagactgcatcaaagccaaggtgcccttaggggacctggatctatatgatggcacatacataactttggagagcaaagacatcagtcctgaagattatatagacacagaatctcctgtccctccagacccagagcaacctgattgtactaaaattctagaacttccatatagtatacatgcttttcagcacttgagaggtgtacaggagagagttaatctttctgcacctctgctacctaaagaaga

SEQ ID NO: 190483 - DNA, 419 bp, Homo sapiens
  Payload ID: 17627
  Gene Name: tetratricopeptide repeat domain 17
  ENST ID: ENST00000525029
  CDS Start-End: 1-419
tgggtttgagcaagctataaagaggaagcatgctgtcctatgtcagcaaaaactggagcagaaattggaggctcagcatagatctctccagcgaacactgaatgagttaaaagagtatcaaaagcagcatgaccactacctgagacagcaggaaatcctagaaaaacataaactgattcaggaggagcaaatcttaagaaatatcattcatgagactcagatggcaaaagaggcacaattaggaaatcatcagatatgccgactggtcaaccagcagcatagtttacattgccagtgggaccagcctgtacgctatcatcgtggagatatctttgaaaatgtggactatgttcaggtctttttcttggtccagtctaattcttataaacgtttgctttataaagattttttaaaacttt

SEQ ID NO: 190484 - DNA, 3002 bp, Homo sapiens
  Payload ID: 17628
  Gene Name: tetratricopeptide repeat domain 19
  Uniprot ID: Q6DKK2
  ENST ID: ENST00000261647
  CDS Start-End: 470-1612
cgaacaagaggtttagagaaccacatggaaaaaaggcagggccaggcccggacaccccgcctcctgcctcccggcccggcggtgcccggatgccccgcccgcgcccatggcgcagccacacacgacctcggtcccgtacttcgcgcgctctcctgcaccgccgccgccatctcgctcaggagctcctccacaaccgccggcaacactacggccatcgcgccgcaggacacgccctccacgaccggcggaccgccgcgacgctccagctgactgcgcctacctgtggaggatcctgaccccccgccggggcagggcgagacggagtgacgtcggggcgcgtcatcgcgcgtgcggacgcagggatgtcctgctcagtcgtcagggcccggccaatccggagggcgctcggcgcgtggtcgggggccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggagggggcatgaagcaggaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttcataataaatgagactacacaacaatattgtatgtatcccagtaatctttgcatttctcaaaaaaaaaaaaaaaaaaaaaaaaaaaactttctgaagaaaataaaaacaccagaaaccttgaggtccaaatcctcagggattagactaaaact

SEQ ID NO: 190485 - DNA, 636 bp, Homo sapiens
  Payload ID: 17628
  Gene Name: tetratricopeptide repeat domain 19
  ENST ID: ENST00000470399
  CDS Start-End: 1-450
ggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaagttgagcattatgaaagatgagccagaagaggctgagttaattttgcatgacgctcttcgtctcgcctatcagactgataacaagaaggccatcacttacacttatgatttgattaattggtgatgtgcttttcattttcaactattttttaaattttgagggtgaaagcaaaagggaattttaaagttttgaaataagtaggaacacagtattctaaactgaaaaacaatttgtaatttgctttcagatggccaacttagcatttatacggggtcagcttgaaaatgctgaacaactttttaaagcaac

SEQ ID NO: 190486 - DNA, 760 bp, Homo sapiens
  Payload ID: 17628
  Gene Name: tetratricopeptide repeat domain 19
  ENST ID: ENST00000470649
  CDS Start-End: 1-300
tccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagctgccaccacagtgcttggtccttccaaggaagctaaggccacgttgggatgaggccctcacttcatccggcaactaccaccacgtccggcagcgccagccccacacttgcccataccatgtcctctgtctccgagctcgcctgcatctactcagccctcactctgcatgacaatgaggtgaccatcacggaggataagatcaatgccctcgttaaagcagctggtgtaaatgttgaacctttttggtccagcttgtttgcaatggccctggccaatgtcaacattgggagcctcatctacaatgtaggggctggtggacctgctccagcagctggtgctgcaccagtgggatcctgcccactccactgctgctgctccagctgagaagaaagtggaagcaaacaaagaagaatctgaggagtctgatgatgacatgggcttttggttgttttgactaaatttcttataacgtgttcaatacaaagctgaacttaagaaaaaaaaaaaaagaa

SEQ ID NO: 190487 - DNA, 2591 bp, Homo sapiens
  Payload ID: 17628
  Gene Name: tetratricopeptide repeat domain 19
  ENST ID: ENST00000475723
  CDS Start-End: 1-500
gccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaaggtgaggcggctccgggccctgcgcccggccgagcgcggtagcctttgtgagcggggtcttggcgttgctgcgcattactctctccgcctcgccgaagagtggatggaggctccgcgggtaaaattgccgagaatgagttgagcattatgaaagatgagccagaagaggctgagttaattttgcatgacgctcttcgtctcgcctatcagactgataacaagaaggccatcacttacacttatgatttgatggccaacttagcatttatacggggtcagcttgaaaatgctgaacaactttttaaagcaacaatgagttacctccttggagggggcatgaagcaggaggacaatgcaataattgaaatttccctaaagctggccagtatctatgctgcgcagaacagacaggaatttgctgttgctggctatgaattctgcatttcaactctagaggaaaaaattgaaagagaaaaggaattagcagaagacattatgtcagtggaagagaaagccaatacccacctcctcttgggcatgtgcttagacgcctgtgctcgctaccttctgttctccaagcagccgtcacaggcacaaaggatgtatgaaaaagctctgcagatttctgaagaaatacaaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagagaacgatatacacaagcaaaagagatctaccaggaagcactgaagcaagcaaagctgaaaaaagatgaaatttctgtacaacacatcagggaagagttggctgagctgtcaaagaaaagtagacctttgacaaattctgtcaagctctaaatccatttttgtgtagggagaataatgtctagtaatgtggaagaatagctatcattcctgtctctgtggcacccgatcaatggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccatttacctaaggaaaaagacagtttttctaggtaccatgaaggaagattgaccctgttggtatgcctgtgggggtgggatgtgagtgggactgataaactgatacttttggttcgtatgtacatactggaagaatcttcataataaatgagactacacaacaata

SEQ ID NO: 190488 - DNA, 908 bp, Homo sapiens
  Payload ID: 17628
  Gene Name: tetratricopeptide repeat domain 19
  ENST ID: ENST00000466729
  CDS Start-End: 1-518
ctcggcgcgtggtcgggggccaggagcgcgtctggcctgcagtgcgcagaggacgcggcgggagcatgttccggctcctgagctggagcctgggccgaggcttcctgcgggccgcggggcggcggtgccggggctgctccgcgcgcctgctcccggggctggcaggaggtccggggcccgaggtgcaggtgccgccatcccgagtcgcgccgcacggccggggcccaggcctgctgccgctgctggcagcgctcgcctggttctcgaggcccgctgcggcagaggaggaggagcagcagggagccgacggggccgctgccgaggacggggcggacgaggccgaggcagagatcatccagctgctgaagcgagccaaggtgaggcggctccgggccctgcgcccggccgagcgcggtagcctttgtgagcggggtcttggcgttgctgcgcattactctctccgcctcgccgaagagtggatggaggctccgcgggtaaaattgccgagaatgagttgagcattatgaaagatgagccagaagaggctgagttaattttgcatgacgctcttcgtctcgcctatcagactgataacaagaaggccatcacttacacttatgatttgattaattggtgatgtgcttttcattttcaactattttttaaattttgagggtgaaagcaaaagggaattttaaagttttgaaataagtaggaacacagtattctaaactgaaaaacaatttgtaatttgctttcagatggccaacttagcatttatacggggtcagcttgaaaatgctgaacaactttttaaagcaacaatgagttacctccttggagggggcatgaagcaggaggacaatgcaataattgaaatttccctaaagctggccagtatctatgct

SEQ ID NO: 190489 - DNA, 561 bp, Homo sapiens
  Payload ID: 17628
  Gene Name: tetratricopeptide repeat domain 19
  ENST ID: ENST00000578103
  CDS Start-End: 1-191
aaggagaaagacacccacagaccattgtgctgatgagtgacctggctactaccctggatgcacagggccgctttgatgaggcctatatttatatgcaaagggcatcagatctggcaagacagataaatcatcctgagctacacatggtactcagtaatctagctgcagttttgatgcacagaggtaggtagcaatgtaaacttaactgacttgctttaagggagggatgtcactggattgatagatttgtgaagtggtatgtagggagggcaagggccaacgaataaacatgtaaattaaaagactggttgaatggcagaaaaaggaggtattgattaggttgaagtactattgtgttcaattcacgtaacttctacagacctgcactagcctgtcgaaccccatcaagctggagaaaaccttgcaatgatagtaccttacgtcagtagtgctttacagatttctaaatgtgttcagttacaatgtgtttctcacagtgtgctggtgaagctttatgacaggaagtatcattttgtcagacatttcttagtgtcagcacac

SEQ ID NO: 190490 - DNA, 555 bp, Homo sapiens
  Payload ID: 17629
  Gene Name: tetratricopeptide repeat domain 21A
  ENST ID: ENST00000431559
  CDS Start-End: 109-441
gtaacgccttcaaccgcccgccgcgatagagtgcccacgaccctgcctcgggaatcccgctctgcaccgccccaccagacccggactcggagccgcgagcggcccgagatgagcagcaatgactcctcccttatggctgggatcatttactatagccaggaaaagtacttccaccatgtgcagcaggctgcagctgtgggcctggaaaaattcagcaatgaccctgtgttgaagttctttaaagcctatggagtcctcaaagaaggcaatgtacttcatgatgcagcagaactactcagaggccctggaggtggtgaaccagatcactgtgacttcagggagcttcctgccagccctcgtcctgaagatgcagctgttcttagctcggcaggactgggagcagacagtagaaatgggacacagaatcctagaaaaagatgagagcaatattgatgcctgccaaattctaaccgtgcatgagcttgcaagagaaggaaacatgaccacagctaccaatcacgttagaaatctgattaaggcactagagacaaggga

SEQ ID NO: 190491 - DNA, 4209 bp, Homo sapiens
  Payload ID: 17629
  Gene Name: tetratricopeptide repeat domain 21A
  Uniprot ID: Q8NDW8
  ENST ID: ENST00000431162
  CDS Start-End: 135-4097
ggctagcagctcggtttccaaggactgtaacgccttcaaccgcccgccgcgatagagtgcccacgaccctgcctcgggaatcccgctctgcaccgccccaccagacccggactcggagccgcgagcggcccgagatgagcagcaatgactcctcccttatggctgggatcatttactatagccaggaaaagtacttccaccatgtgcagcaggctgcagctgtgggcctggaaaaattcagcaatgaccctgtgttgaagttctttaaagcctatggagtcctcaaagaagagcacatccaggatgccatcagtgacctggaaagcatcaggcatcacccagacgtgtccctgtgctccaccatggccctcatttatgctcacaaaagatgtgaaatcattgaccgagaagcaattcaggagcttgagtacagcctgaaggaaatacgcaagacagtcagtgggactgcactgtactatgctggccttttcctctggctcataggccgccatgacaaggccaaagagtacattgaccgcatgctgaagatttctagaggcttcagagaggcctatgtgctcagaggctgggtggacctgacctcagacaagccccacactgcgaagaaagccattgagtacctggaacaaggaattcaggacaccaaagatgtgctggggctgatgggaaaggcaatgtacttcatgatgcagcagaactactcagaggccctggaggtggtgaaccagatcactgtgacttcagggagcttcctgccagccctcgtcctgaagatgcagctgttcttagctcggcaggactgggagcagacagtagaaatgggacacagaatcctagaaaaagatgagagcaatattgatgcctgccaaattctaaccgtgcatgagcttgcaagagaaggaaacatgaccacagtaagttctttgaagactcagaaggctaccaatcacgttagaaatctgattaaggcactagagacaagggaacccgaaaatccaagcctccatcttaaaaaaattattgtggttagccgactgtgtgggagtcaccaggtgattctagggctagtgtgtagtttcatcgagcgcaccttcatggccaccccctcgtatgtccatgtggccacagaactgggctatctcttcatcctgaagaaccaagtgaaagaggccttgctgtggtattcagaagccatgaaactggacaaggatggcatggctggtttgacagggatcatcttgtgtcatatcttagaaggccacctggaggaagctgagtaccggctggaattcctgaaggaggtgcagaagtcccttgggaagtctgaggtgctaattttcctccaagccctcctgatgtccaggaagcacaagggggaggaagagaccacagcgctcctgaaggaggcagtggagcttcacttctccagcatgcaaggcatccctcttggctctgagtactttgaaaagctggacccgtacttcctggtctgcattgctaaggagtacttgctcttctgccccaagcagcccaggttaccaggccagatcgtgtctccacttcttaaacaagtcgccgtgatcttgaatcctgtagtcaaagcagcaccagctctgatcgaccccctgtatttgatggctcaggtcaggtattactcagagctagagaatgcccagagcatcctgcagcgttgcctggagctggaccccgcctccgtggatgcccatctcctcatgtgtcagatctacttggctcagggcaactttggcatgtgcttccactgcttagagctgggtgtcagccacaacttccaggtccgagatcaccccctctaccacctcatcaaggccagggccctcaacaaggctggagactatccagaggccataaagacgctgaaaatggtcatcaaattgccagctctgaagaaggaagaaggcagaaagttcctcaggccctctgtgcagcctagccagcgggcatccatcttattggaactggtggaggccctccggctgaatggggagctacatgaggccaccaaggtcatgcaggacaccatcaatgagttcggtggcacaccagaagagaaccgcatcaccattgccaacgtggacttggtcctgagcaagggcaatgtggacgtggcgctgaacatgctaaggaacatcttgcccaagcagtcctgctatatggaagccagagagaagatggccaacatctacctgcagaccctcagagacaggcgcctctacatcagatgctaccgtgagctctgtgaacatctgcctggcccccacaccagcctgctactgggcgatgccttaatgagcattctggagcccgagaaggccctggaggtctatgatgaggcctatagacagaacccacatgacgcctccctggccagcagaattgggcacgcttatgtgaaggcccaccagtatactgaggcaattgagtattatgaggctgcccagaagattaatggacaggactttctgtgctgcgatctgggcaaactgctcctgaagttaaagaaggtcaataaagcagaaaaagttttgaagcaggcactggaacatgacattgtccaagacatcccatccatgatgaatgatgttaagtgcctgcttttgctggcaaaggtttacaagagccataaaaaagaagctgtgatagaaactttgaacaaggccttggacctccagtctcggatactgaagcgagttccactggagcaaccagaaatgattccctcccagaagcaactggcagcctctatctgcatccaatttgcagagcactacctggcagagaaagagtatgacaaggcggtacagtcttataaggatgtcttctcctacttgccaactgacaataaggtgatgctggagctggcgcagctctacctgctccaggggcacctggacctgtgtgagcagcactgtgccatcctcctgcagactgagcagaaccatgagaccgcttctgtgttgatggctgacctgatgtttagaaaacagaaacatgaagcggccatcaatctttaccaccaagtcttggagaaagcgccagacaattttttggtattgcataaattaatcgatctgctaagaagaagtggaaaacttgaagacattcctgccttctttgaattggccaagaaggtgtctagccgggtgcctttggaaccagggttcaattactgcagaggtatctactgctggcacatagggcagcccaacgaagccttaaagttcctgaacaaggcacgcaaggacagcacttggggccagagcgccatctaccacatggtgcagatctgtctgaatccagacaacgaggttgtgggcggagaggcttttgagaaccagggagctgagagcaactacatggagaagaaggagttggagcagcagggtgtgagcaccgccgagaaactgctgcgtgagttttacccacattcagactccagccagacccagctgcggctgctgcagggcctctgccggctggccaccagggagaaggctaacatggaggctgcgctgggcagcttcatccagatagcgcaggctgagaaggacagcgtccctgccctgctggccttggcacaagcctacgtgttcctgaagcagatccccaaggcgcgtatgcagttgaagcgcctggccaagaccccctgggtgctgagtgaggctgaggacctggagaagagctggctcctgctggctgacatttactgccagggcagcaagttcgacctcgccttagaactgctgcggcgctgtgtgcaatacaacaagtcctgctacaaggcctatgagtacatgggcttcatcatggagaaggagcagtcctacaaggatgcagtcaccaactacaaactggcctggaagtacagtcatcacgccaaccctgccattggcttcaaacttgctttcaactacctgaaggacaagaaatttgtggaggccattgaaatctgcaacgatgtcctcagggagcaccccgactaccccaagatcagggaggaaattttggaaaaggcccgaaggtccctgaggccctagctggggtcaaggggcctggaccagtagaagccatcaacctactgaagttgtgtggagggatggaaagtgggtcagtggagaagggattcagaaaatgacacattcttcccca

SEQ ID NO: 190492 - DNA, 3988 bp, Homo sapiens
  Payload ID: 17629
  Gene Name: tetratricopeptide repeat domain 21A
  ENST ID: ENST00000430597
  CDS Start-End: 110-3541
tgtaacgccttcaaccgcccgccgcgatagagtgcccacgaccctgcctcgggaatcccgctctgcaccgccccaccagacccggactcggagccgcgagcggcccgagatgagcagcaatgactcctcccttatggctgggatcatttactatagccaggaaaagtacttccaccatgtgcagcaggctgcagctgtgggcctggaaaaattcagcaatgaccctgtgttgaagttctttaaagcctatggagtcctcaaagaagagcacatccaggatgccatcagtgacctggaaagcatcaggcatcacccagacgtgtccctgtgctccaccatggccctcatttatgctcacaaaagatgtgaaatcattgaccgagaagcaattcaggagcttgagtacagcctgaaggaaatacgcaagacagtcagtgggactgcactgtactatgctggccttttcctctggctcataggccgccatgacaaggccaaagagtacattgaccgcatgctgaagatttctagaggcttcagagaggcctatgtgctcagaggctgggtggacctgacctcagacaagccccacactgcgaagaaagccattgagtacctggaacaaggaattcaggacaccaaagatgtgctggggctgatgggaaaggcaatgtacttcatgatgcagcagaactactcagaggccctggaggtggtgaaccagatcactgtgacttcagggagcttcctgccagccctcgtcctgaagatgcagctgttcttagctcggcaggactgggagcagacagtagaaatgggacacagaatcctagaaaaagatgagagcaatattgatgcctgccaaattctaaccgtgcatgagcttgcaagagaaggaaacatgaccacagctaccaatcacgttagaaatctgattaaggcactagagacaagggaacccgaaaatccaagcctccatcttaaaaaaattattgtggttagccgactgtgtgggagtcaccaggtgattctagggctagtgtgtagtttcatcgagcgcaccttcatggccaccccctcgtatgtccatgtggccacagaactgggctatctcttcatcctgaagaaccaagtgaaagaggccttgctgtggtattcagaagccatgaaactggacaaggatggcatggctggtttgacagggatcatcttgtgtcatatcttagaaggccacctggaggaagctgagtaccggctggaattcctgaaggaggtgcagaagtcccttgggaagtctgaggtgctaattttcctccaagccctcctgatgtccaggaagcacaagggggaggaagagaccacagcgctcctgaaggaggcagtggagcttcacttctccagcatgcaaggcatccctcttggctctgagtactttgaaaagctggacccgtacttcctggtctgcattgctaaggagtacttgctcttctgccccaagcagcccaggttaccaggccagatcgtgtctccacttcttaaacaagtcgccgtgatcttgaatcctgtagtcaaagcagcaccagctctgatcgaccccctgtatttgatggctcaggtcaggtattactcaggagagctagagaatgcccagagcatcctgcagcgttgcctggagctggaccccgcctccgtggatgcccatctcctcatgtgtcagatctacttggctcagggcaactttggcatgtgcttccactgcttagagctgggtgtcagccacaacttccaggtccgagatcaccccctctaccacctcatcaaggccagggccctcaacaaggctggagactatccagaggccataaagacgctgaaaatggtcatcaaattgccagctctgaagaaggaagaaggcagaaagttcctcaggccctctgtgcagcctagccagcgggcatccatcttattggaactggtggaggccctccggctgaatggggagctacatgaggccaccaaggtcatgcaggacaccatcaatgagttcggtggcacaccagaagagaaccgcatcaccattgccaacgtggacttggtcctgagcaagggcaatgtggacgtggcgctgaacatgctaaggaacatcttgcccaagcagtcctgctatatggaagccagagagaagatggccaacatctacctgcagaccctcagagacaggcgcctctacatcagatgctaccgtgagctctgtgaacatctgcctggcccccacaccagcctgctactgggcgatgccttaatgagcattctggagcccgagaaggccctggaggtctatgatgaggcctatagacagaacccacatgacgcctccctggccagcagaattgggcacgcttatgtgaaggcccaccagtatactgaggcaattgagtattatgaggctgcccagaagattaatggacaggactttctgtgctgcgatctgggcaaactgctcctgaagttaaagaaggtcaataaagcagaaaaagttttgaagcaggcactggaacatgacattgtccaagacatcccatccatgatgaatgatgttaagtgcctgcttttgctggcaaaggtttacaagagccataaaaaagaagctgtgatagaaactttgaacaaggccttggacctccagtctcggatactgaagcgagttccactggagcaaccagaaatgattccctcccagaagcaactggcagcctctatctgcatccaatttgcagagcactacctggcagagaaagagtatgacaaggcggtacagtcttataaggatgtcttctcctacttgccaactgacaataaggtgatgctggagctggcgcagctctacctgctccaggggcacctggacctgtgtgagcagcactgtgccatcctcctgcagactgagcagaaccatgagaccgcttctgtgttgatggctgacctgatgtttagaaaacagaaacatgaagcggccatcaatctttaccaccaagtcttggagaaagcgccagacaattttttggtattgcataaattaatcgatctgctaagaagaagtggaaaacttgaagacattcctgccttctttgaattggccaagaaggtgtctagccgggtgcctttggaaccagggttcaattactgcagaggtatctactgctggcacatagggcagcccaacgaagccttaaagttcctgaacaaggcacgcaaggacagcacttggggccagagcgccatctaccacatggtgcagatctgtctgaatccagacaacgaggttgtgggcggagaggcttttgagaaccagggagctgagagcaactacatggagaagaaggagttggagcagcagggtgtgagcaccgccgagaaactgctgcaaggacagcgtccctgccctgctggccttggcacaagcctacgtgttcctgaagcagatccccaaggcgcgtatgcagttgaagcgcctggccaagaccccctgggtgctgagtgaggctgaggacctggagaagagctggctcctgctggctgacatttactgccagggcagcaagttcgacctcgccttagaactgctgcggcgctgtgtgcaatacaacaagtcctgctacaaggcctatgagtacatgggcttcatcatggagaaggagcagtcctacaaggatgcagtcaccaactacaaactggcctggaagtacagtcatcacgccaaccctgccattggcttcaaacttgctttcaactacctgaaggacaagaaatttgtggaggccattgaaatctgcaacgatgtcctcagggagcaccccgactaccccaagatcagggaggaaattttggaaaaggcccgaaggtccctgaggccctagctggggtcaaggggcctggaccagtagaagccatcaacctactgaagttgtgtggagggatggaaagtggg

SEQ ID NO: 190493 - DNA, 562 bp, Homo sapiens
  Payload ID: 17629
  Gene Name: tetratricopeptide repeat domain 21A
  ENST ID: ENST00000425163
  CDS Start-End: 33-419
agacccggactcggagccgcgagcggcccgagatgagcagcaatgactcctcccttatggctgggatcatttactatagccaggaaaagtacttccaccatgtgcagcaggctgcagctgtgggcctggaaaaattcagcaatgaccctgtgttgaagttctttaaagcctatggagtcctcaaagaagagcacatccaggatgccatcagtgacctggaaagcatcaggcatcacccagacgtgtccctgtgctccaccatggccctcatttatgctcacaaaagatgtgaaatcattggtgagtgccaccatgctcaaccaggcctgacccaccaggggaaggaaagccctgccccagagataacacagcccctcaagggctgccaaaggagaccgagaagcaattcaggagcttgagtacagcctgaaggaaatacgcaagacagtcagtgggactgcactgtactatgctggccttttcctctggctcataggccgccatgacaaggccaaagagtacattgaccgcatgctgaagatttctagaggcttcagagagg

SEQ ID NO: 190494 - DNA, 3941 bp, Homo sapiens
  Payload ID: 17629
  Gene Name: tetratricopeptide repeat domain 21A
  Uniprot ID: Q8NDW8
  ENST ID: ENST00000440121
  CDS Start-End: 32-3850
gacccggactcggagccgcgagcggcccgagatgagcagcaatgactcctcccttatggctgggatcatttactatagccaggaaaagtacttccaccatgtgcagcaggctgcagctgtgggcctggaaaaattcagcaatgaccctgtgttgaagttctttaaagcctatggagtcctcaaagaagagcacatccaggatgccatcagtgacctggaaagcatcaggcatcacccagacgtgtccctgtgctccaccatggccctcatttatgctcacaaaagatgtgaaatcattgaccgagaagcaattcaggagcttgagtacagcctgaaggaaatacgcaagacagtcagtgggactgcactgtactatgctggccttttcctctggctcataggccgccatgacaaggccaaagagtacattgaccgcatgctgaagatttctagaggcttcagagaggcaatgtacttcatgatgcagcagaactactcagaggccctggaggtggtgaaccagatcactgtgacttcagggagcttcctgccagccctcgtcctgaagatgcagctgttcttagctcggcaggactgggagcagacagtagaaatgggacacagaatcctagaaaaagatgagagcaatattgatgcctgccaaattctaaccgtgcatgagcttgcaagagaaggaaacatgaccacagctaccaatcacgttagaaatctgattaaggcactagagacaagggaacccgaaaatccaagcctccatcttaaaaaaattattgtggttagccgactgtgtgggagtcaccaggtgattctagggctagtgtgtagtttcatcgagcgcaccttcatggccaccccctcgtatgtccatgtggccacagaactgggctatctcttcatcctgaagaaccaagtgaaagaggccttgctgtggtattcagaagccatgaaactggacaaggatggcatggctggtttgacagggatcatcttgtgtcatatcttagaaggccacctggaggaagctgagtaccggctggaattcctgaaggaggtgcagaagtcccttgggaagtctgaggtgctaattttcctccaagccctcctgatgtccaggaagcacaagggggaggaagagaccacagcgctcctgaaggaggcagtggagcttcacttctccagcatgcaaggcatccctcttggctctgagtactttgaaaagctggacccgtacttcctggtctgcattgctaaggagtacttgctcttctgccccaagcagcccaggttaccaggccagatcgtgtctccacttcttaaacaagtcgccgtgatcttgaatcctgtagtcaaagcagcaccagctctgatcgaccccctgtatttgatggctcaggtcaggtattactcaggagagctagagaatgcccagagcatcctgcagcgttgcctggagctggaccccgcctccgtggatgcccatctcctcatgtgtcagatctacttggctcagggcaactttggcatgtgcttccactgcttagagctgggtgtcagccacaacttccaggtccgagatcaccccctctaccacctcatcaaggccagggccctcaacaaggctggagactatccagaggccataaagacgctgaaaatggtcatcaaattgccagctctgaagaaggaagaaggcagaaagttcctcaggccctctgtgcagcctagccagcgggcatccatcttattggaactggtggaggccctccggctgaatggggagctacatgaggccaccaaggtcatgcaggacaccatcaatgagttcggtggcacaccagaagagaaccgcatcaccattgccaacgtggacttggtcctgagcaagggcaatgtggacgtggcgctgaacatgctaaggaacatcttgcccaagcagtcctgctatatggaagccagagagaagatggccaacatctacctgcagaccctcagagacaggcgcctctacatcagatgctaccgtgagctctgtgaacatctgcctggcccccacaccagcctgctactgggcgatgccttaatgagcattctggagcccgagaaggccctggaggtctatgatgaggcctatagacagaacccacatgacgcctccctggccagcagaattgggcacgcttatgtgaaggcccaccagtatactgaggcaattgagtattatgaggctgcccagaagattaatggacaggactttctgtgctgcgatctgggcaaactgctcctgaagttaaagaaggtcaataaagcagaaaaagttttgaagcaggcactggaacatgacattgtccaagacatcccatccatgatgaatgatgttaagtgcctgcttttgctggcaaaggtttacaagagccataaaaaagaagctgtgatagaaactttgaacaaggccttggacctccagtctcggatactgaagcgagttccactggagcaaccagaaatgattccctcccagaagcaactggcagcctctatctgcatccaatttgcagagcactacctggcagagaaagagtatgacaaggcggtacagtcttataaggatgtcttctcctacttgccaactgacaataaggtgatgctggagctggcgcagctctacctgctccaggggcacctggacctgtgtgagcagcactgtgccatcctcctgcagactgagcagaaccatgagaccgcttctgtgttgatggctgacctgatgtttagaaaacagaaacatgaagcggccatcaatctttaccaccaagtcttggagaaagcgccagacaattttttggtattgcataaattaatcgatctgctaagaagaagtggaaaacttgaagacattcctgccttctttgaattggccaagaaggtgtctagccgggtgcctttggaaccagggttcaattactgcagaggtatctactgctggcacatagggcagcccaacgaagccttaaagttcctgaacaaggcacgcaaggacagcacttggggccagagcgccatctaccacatggtgcagatctgtctgaatccagacaacgaggttgtgggcggagaggcttttgagaaccagggagctgagagcaactacatggagaagaaggagttggagcagcagggtgtgagcaccgccgagaaactgctgcgtgagttttacccacattcagactccagccagacccagctgcggctgctgcagggcctctgccggctggccaccagggagaaggctaacatggaggctgcgctgggcagcttcatccagatagcgcaggctgagaaggacagcgtccctgccctgctggccttggcacaagcctacgtgttcctgaagcagatccccaaggcgcgtatgcagttgaagcgcctggccaagaccccctgggtgctgagtgaggctgaggacctggagaagagctggctcctgctggctgacatttactgccagggcagcaagttcgacctcgccttagaactgctgcggcgctgtgtgcaatacaacaagtcctgctacaaggcctatgagtacatgggcttcatcatggagaaggagcagtcctacaaggatgcagtcaccaactacaaactggcctggaagtacagtcatcacgccaaccctgccattggcttcaaacttgctttcaactacctgaaggacaagaaatttgtggaggccattgaaatctgcaacgatgtcctcagggagcaccccgactaccccaagatcagggaggaaattttggaaaaggcccgaaggtccctgaggccctagctggggtcaaggggcctggaccagtagaagccatcaacctactgaagttgtgtggagggatggaaagtgggtcagtggagaagggattcag

SEQ ID NO: 190495 - DNA, 5482 bp, Homo sapiens
  Payload ID: 17630
  Gene Name: tetratricopeptide repeat domain 21B
  Uniprot ID: Q7Z4L5
  ENST ID: ENST00000243344
  CDS Start-End: 139-4089
gcggcgcgaccccgcccctcccgctggggcccggggcgctagagcgctccgggaggctaggggagctgaattctgcgtcttcctttaggctgcggcgagacaatccccagagccccgcggcccggcctcggggcagccatggactcgcaggaattgaagactttgattaattactattgtcaagagagatatttccatcatgtattactggttgccagtgaaggaattaagaggtatggaagtgatccagtcttcaggttttatcatgcctatggcacattaatggaaggtaaaactcaagaagctcttcgagaatttgaggctattaaaaataaacaagatgtatcactttgttctctacttgcactgatatatgcccataaaatgagtcctaatccagatagagaagctattctggaatcagatgccagagtgaaggaacaacgtaaaggagctggagagaaagccttataccatgcaggcttatttttatggcacattggtcgccatgataaagcaagggaatatattgacagaatgatcaaaatatcagatggtagtaaacagggacacgttttgaaagcatggcttgatattacaagaggaaaagagccttacactaaaaaagcactgaagtattttgaagagggactccaagatgggaatgatacttttgctctgctgggtaaggcacaatgccttgagatgcgccagaattattcaggtgccctggagactgtgaaccagataatcgtgaattttccgagcttccttcctgcttttgttaagaaaatgaaattacaactagccttgcaggattgggaccagacagttgagacagcacaaaggttgctgctccaagatagccaaaatgtggaagcactgagaatgcaggcactctactatgtgtgtagagagggggatatagagaaggcttccaccaagctggaaaacttgggaaatacattggatgccatggaaccacagaatgctcaacttttctataacattacactcgccttcagcagaacttgtggacgtagtcaacttattcttcaaaaaattcaaacgttacttgagagagcttttagtttaaaccctcagcaatcagaatttgctacagaacttggataccaaatgattttacaaggaagagttaaagaggcactgaagtggtataagaccgccatgacacttgatgagactagtgtgtctgccctagttggatttatccaatgtcagttgatagaagggcaattacaggatgcagatcagcagctagaatttttaaatgaaatccagcaatccattggaaaatctgcggaattaatctatttacatgcagttcttgccatgaagaaaaataaacgacaagaagaagttattaatttgttaaatgatgtcctggacactcacttttcacaattagaaggtttgcctcttggcatacagtattttgaaaagctaaatcctgatttcttgttagaaattgttatggagtatctgagcttctgtccaatgcagcctgcaagtcctgggcaacctctttgtccacttctcaggcgttgcatctcagtcctggagactgtagtaagaactgttccaggtcttctgcaaacagtcttcctaatagcaaaagtgaaatatttgtcaggtgatattgaagcagctttcaataaccttcagcactgcttagaacacaatccctcttatgctgatgctcatctgctgctagctcaggtttacttgtctcaagaaaaagtcaaattgtgttctcagtctcttgaactttgtctgagctatgattttaaggtgagagactatcctttataccatttgataaaagctcagtcacaaaagaaaatgggagaaatagcagacgcaattaaaacactgcatatggcaatgagtttaccaggaatgaaaagaattggagcttccacaaaatcaaaagacagaaaaactgaagttgatacaagccatcgtttatcgatctttcttgaattgatagacgttcaccgcttaaatggagagcagcatgaggcaaccaaagttttacaagatgccatccatgaattttctggaacatctgaagaagtgcgggttaccattgctaatgcagaccttgctctagcccaaggagatattgaacgggctttaagcatccttcagaatgttacagccgaacagccttattttatagaggccagagaaaaaatggcagatatttatctgaagcacagaaaagataaaatgttatatatcacttgttttagagaaattgctgaaagaatggctaaccctcggtcttttcttctccttggtgatgcatacatgaatattctagagcctgaagaagccatagtagcatatgagcaagcattaaatcagaacccgaaagatggaacattggcaagcaaaatgggcaaagcacttatcaaaactcataactactcaatggcaatcacttactatgaagctgctctgaaaactggacaaaagaattatctttgctatgacctggctgagctcttattaaaattgaaatggtatgacaaagcagaaaaagttcttcagcatgctctggctcatgaacctgtaaatgaactgtcagctctcatggaggatggacgttgtcaagttcttctagcaaaagtttatagtaaaatggaaaaacttggtgatgcgatcactgcattacaacaggctcgagaattacaagctcgggtactaaaacgtgttcagatggaacagccagatgcagttcctgcacagaaacatttagcagctgaaatttgtgcagagattgcaaaacattctgttgctcagcgagactatgaaaaagcaattaagttttatagagaggctctggttcactgcgaaacagataataagattatgttggaactggcacgattatacctggcacaagatgaccctgattcctgcctgcggcagtgtgctctactgcttcagagtgaccaggataacgaagctgctaccatgatgatggctgatctcatgttcagaaaacaagactatgaacaagcagtgtttcatttacagcagcttttagaacgtaagccagataattatatgacattatctcgtttgattgatctcctaagaagatgtggaaaactcgaggatgtcccaagatttttctcaatggctgagaaacgtaactccagagcaaaattggaaccaggatttcagtattgtaaaggactgtatctttggtacactggagaaccaaatgatgcccttcgacattttaataaagctcggaaagatcgtgactggggccaaaatgccctttataatatgatagagatctgtttgaatccagataatgaaactgttggaggtgaagtatttgaaaacctggatggagacctgggtaattcaactgagaagcaagaatctgtgcaactggcagtaagaacagcagaaaaacttcttaaggaactaaaacctcagactgttcagggtcacgtacagcttcgcataatggaaaactattgcttaatggctaccaaacagaaatctaatgttgaacaagcattaaataccttcactgaaatagcagcatctgagaaggagcatatcccagcgctcttgggaatggcaacggcttatatgatcttgaaacagactccacgagccagaaaccagctgaagcgtattgcgaaaatgaattggaatgctattgatgctgaagagtttgagaagagttggctgctacttgctgatatttacattcaatcagcaaaatatgacatggcagaagacctgttaaaacggtgcctgcgtcataatagatcttgctgcaaagcttatgaatatatgggatacattatggaaaaagagcaagcatatacagatgctgccttgaactatgagatggcatggaaatatagcaatcggacaaatccggcagtaggatacaaactggcatttaattacttaaaagcaaaaagatatgtggattcaattgacatatgtcaccaggttcttgaagcacatccaacttatccaaaaatcagaaaggatatacttgataaggcccgtgcgtctttaagaccttgaaaataattttaacttaggtgttggtttaacaggaaatgaaagaaatctaactttcagttcttcctgttcaaaacaggtttgagctcagtgctttgttattagaagtatacccttttttctccagcagaggttgctgctgtacatcaagagaagtactatgtgaaattggtgtttcctaatggagttgaatgagagctggtctatttgactctgttttgattgggtacagatttggtgactctgtggtaaagactataattatttctataaagaatattttgttaaaatctaggtaattaaataccctgtatcttttctaaggaatattatttcaggaaatatatttaaaatgcattgttctcttttaaagtgtttttgttatattcttttatttatttatttatttttaaagacagagccttgatctgccgcccaggctggagtgcagtggcacgatcttggctcactgcaacctccgcctcctgggtttacgcgattctcctgcttcagcctcccgagtagctgggactaaaggcatgtgccatcacacccggctaattttttgtatttttagtagagatgggatttcaccgtgttagccaggaggggcttgatctcttgaccttgtgatccacctgcctcggcctcccaaagtgctgggattacaggcatgagccaccgcacccagcctgtttttgttgtattctgtgttgtttcaaaaattggaataaatctccctgtaaataactcatgaaaaagacaatatatatattttaaatatatattttaataaaggttttataaatagatgatttatattcctcttggaactcaaaagatgtggtaagttttgcaaatcagggtaagctccccctgcattctgtaatgttaatgggtggtggtatagtacagaaaatgtaactttcattgaaaaatcttttttagaaaagggtagagtgtgtgtttccctttcctttcttgagctcattcttcctgctttcaaggccattgtggtcttaagaaataatcaggtcctgaaacctcaatttaaataggtcccttattagggatatttaaccttagcctagaagacttggtctgcaggtataatttcagacactgtaacatttgatggtaaagggtgaccaaatacttttggtcagcagggagtcacaaagcacaccatgtgaaggcaacggtttacccagctctgtttaacagcaccctggcatagaagctttcactctcttacactaaatttaacctaatctaaacttaatccttagcattatttttaatttctcatctacatctttttcaattttccttaaaattgtagtaaacacagtcctcaattttatttgcatttacaataaacagtatttataagtca

SEQ ID NO: 190496 - DNA, 1572 bp, Homo sapiens
  Payload ID: 17630
  Gene Name: tetratricopeptide repeat domain 21B
  ENST ID: ENST00000392695
  CDS Start-End: 1-851
ggtacactggagaaccaaatgatgcccttcgacattttaataaagctcggaaagatcgtgactggggccaaaatgccctttataatatgatagagatctgtttgaatccagataatgaaactgttggaggtgaagtatttgaaaacctggatggagacctgggtaattcaactgagaagcaagaatctgtgcaactggcagtaagaacagcagaaaaacttcttaaggaactaaaacctcagactgttcagggtcacgtacagcttcgcataatggaaaactattgcttaatggctaccaaacagaaatctaatgttgaacaagcattaaataccttcactgaaatagcagcatctgagaaggagcatatcccagcgctcttgggaatggcaacggcttatatgatcttgaaacagactccacgagccagaaaccagctgaagcgtattgcgaaaatgaattggaatgctattgatgctgaagagtttgagaagagttggctgctacttgctgatatttacattcaatcagcaaaatatgacatggcagaagacctgttaaaacggtgcctgcgtcataatagatcttgctgcaaagcttatgaatatatgggatacattatggaaaaagagcaagcatatacagatgctgccttgaactatgagatggcatggaaatatagcaatcggacaaatccggcagtaggatacaaactggcatttaattacttaaaagcaaaaagatatgtggattcaattgacatatgtcaccaggttcttgaagcacatccaacttatccaaaaatcagaaaggatatacttgataaggcccgtgcgtctttaagaccttgaaaataattttaacttaggtgttggtttaacaggaaatgaaagaaatctaactttcagttcttcctgttcaaaacaggatttgattgccttatgtgacaagcccaagatctgtgacagttggagctcaaactaggcagtcttgattccagactgctctgaactagtatttgaaggaactaatgaacatgacatgttaaatgaaagtttggggacgtacactcaggatggaagcagggggacacaacagaaatgaaagaattttctgtagatctgggatctggacacctgccccccgtcatgaataaatgccatcccttcccacgccaaccatatcgatgatatagtggcaggaaggagagtaagggactctggagcttaaacagaccatcacatgggaaggcagtaaacaagatgctaactgatggagtgaaatccccaggagatgcagaaggcaagtgcagctaactgaggcctcaggggcaggagatgcccatcaggatgagagctatgtctttctccagtgatgactctgcttctatgaggtcaccagcagtagaaccatatcttgctggcatacacttgggatggccccgcctcctggacttccatctgtcatcaggagaacataaccatctggagtcagtacagatcatcaatccttccacatatacaagttcattttaaatttttaaaaatataatacaactgagaagtcttcatt

SEQ ID NO: 190497 - DNA, 2149 bp, Homo sapiens
  Payload ID: 17631
  Gene Name: tetratricopeptide repeat domain 22
  Uniprot ID: Q5TAA0
  ENST ID: ENST00000371274
  CDS Start-End: 36-1154
acaagggtgaggccaggggagcagagggagcagtcatggcggagctggaggctgtggccgacgatctagacgccctcatcgacgacctggactacctcccgggccactttcacctggagatgcagttgaacttcgagccgcgctcgccggccccacagcgcgcccgggacctgaagctgcagcgggagggtctgcggcaggagctccagctggcggccgccccgcagcgccccgctgtgcgtcacctcctgggcgctttcgcattctacctggaggagctggacgaggcccgcgagtgcttcctcgaggtggcccacgagcacccgggcaacctcaatgcctgggccaatctggcacacgtgtacgggcggctgggccaggaagaagaggaggaggcgtgcgccgcacggctggccgacctcatgggcctggcagaggagcccgaggccgccggggacccccagctccgcgccgctcgctgcctggccgagcagggctacgcgcatggcttcgacgtcggctgcgccagcccagaggagcgtgcgcgggggctggcggcaggcatcgcgctctacgacaaggcgctaggctacgggcagcagatcccgatggaggagaaaaggggctggtatttcaccatggcaacactctacatcaggctagatggcatcttcctggagctgggcagtgaggagcagaagagactgcctgccttcaaccgcacgctggccctactccggcaagtgctgaagtccgaggacccccgccaccgagccctggcctggtgctacctcgggatgctgctggagcggaaggacaccttctccaccacccccatgggcgtccatgactgcgggtactcagggaccgaccctctagactgcttcggcaaggccattgagattgccaagaaccaacctcccatcctgaatcgcctggcaaaaatcttctacttcctgggaaagcaggatatggccattggaacctgcaacatggccctggatgtcctacgagatccagaactcaactggcaggcgtactgcacaagggccaagagacgaggtctcactatgttgcccagactcgtctcaaactcctgggctcaagcagtcctcccacctcgacctcccaaagtgctggaattccaggtgtgagccactacacccagccctgtaaggtttttgagtgaaagaatgcaggagcctccactcactgcaggaatcccttctacaattcctggtcagtgagcccccagcctcttctggattggcacgggtggaatcagactgaccagagttgaaatctggcttctccgccttgtggaacttgcagcaagccacttacccccacaaacttcagttcccaaatctgtaagatataaataacaacactttccttaaaatgttgtcaacagacacagtgaggtagcatctaaagcacagtgccttggacatagggggtgcttttctgaaagccagtagaggtcatttaatatagtggatcagagctctggctctgaacacagacagccttggttcaaatcccacaacaccacgtgctacgggacctttggcaaaatactcttgcccagattctgagcctcaatttctttatctgtagactggagttgttatgagaattacattagattttgtatgtaaaactcagcatcaagcacacagtaagatttcataagagactgactgctactaatttaatattaggcatatttttgaattatctcactgtctcttgatgcagtccactgcatagtcattcagctctgcaagttacacacttaggtgagttctgcctcctgctagcttcccgcactggtcccagacctgcctcctagagcccacacagagcccatgtgcttgaggaagccgactcggagctcccagtttacttcactgcaagccgaagagtcctcccatcccctcatcttctccactactatccacatgacctagtggcaaatctactcccagtcttggtctcagtggcttaattactttgccagcaggtacgaggcaggagtgaaattccttcactgtcgtggatgtggttattattctagataataatgacattaaccataatagtaaataataaaatatctctataaaattctgcatttcatcaagca

SEQ ID NO: 190498 - DNA, 3345 bp, Homo sapiens
  Payload ID: 17631
  Gene Name: tetratricopeptide repeat domain 22
  Uniprot ID: Q5TAA0
  ENST ID: ENST00000371276
  CDS Start-End: 105-1814
tgcccctcgcctcccgcacggagctcgctcggggaacgcccccatccactgccctccacagcctcagggacaagggtgaggccaggggagcagagggagcagtcatggcggagctggaggctgtggccgacgatctagacgccctcatcgacgacctggactacctcccgggccactttcacctggagatgcagttgaacttcgagccgcgctcgccggccccacagcgcgcccgggacctgaagctgcagcgggagggtctgcggcaggagctccagctggcggccgccccgcagcgccccgctgtgcgtcacctcctgggcgctttcgcattctacctggaggagctggacgaggcccgcgagtgcttcctcgaggtggcccacgagcacccgggcaacctcaatgcctgggccaatctggcacacgtgtacgggcggctgggccaggaagaagaggaggaggcgtgcgccgcacggctggccgacctcatgggcctggcagaggagcccgaggccgccggggacccccagctccgcgccgctcgctgcctggccgagcagggctacgcgcatggcttcgacgtcggctgcgccagcccagaggagcgtgcgcgggggctggcggcaggcatcgcgctctacgacaaggcgctaggctacgggcagcagatcccgatggaggagaaaaggggctggtatttcaccatggcaacactctacatcaggctagatggcatcttcctggagctgggcagtgaggagcagaagagactgcctgccttcaaccgcacgctggccctactccggcaagtgctgaagtccgaggacccccgccaccgagccctggcctggtgctacctcgggatgctgctggagcggaaggacaccttctccaccacccccatgggcgtccatgactgcgggtactcagggaccgaccctctagactgcttcggcaaggccattgagattgccaagaaccaacctcccatcctgaatcgcctggcaaaaatcttctacttcctgggaaagcaggatatggccattggaacctgcaacatggccctggatgtcctacgagatccagaactcaactggcaggcgtactgcacaagggccaagatccacatcagagcctacctgcatgacctcaagcgggccaagatgggtctcgggggcatgcctgacaggaaccacctggcctgtgccaaggctgaccttgaggaagtggtcagggtgtgcccaggcttcaaggcgtacctggacatcggccaggtctactactatatgggcgtggacgcggtgcaggagctgctggcggtggacgaggcggcgctgaaccaggcgctggtgttcctggccaaggcgggcgagtcggagctgggtgccacgctgcccgagctgcagctgctgcgcggcaagtgcctgcgcatcaagggcgaggacgccaacgcggccgcctgcttcaagcgcgcagtggagctggacgacgcgggctccagccacaccgacggcttcggctgcctgctcgaggcgctgctggcgcagtggagccaggcacagctgagcgacggggagctgggccgcgaggtggacgcctggctgcgccgcgcccaggacaagtaccccgcggcgcgcctgcgccaggagctgcagcgcgtgtggcgcgggcacacggacgaggtgttggggctggcccgggccctggtggcccagggacggccggcgctggtgcggctgctcttcgagaccatggagcgcgagggcgagggcgccagcgcgccgcgggaccgccgggctgtctcattctagggctcaggtgcccaggccggaggctccctgggaccccgcccaggccccgcccagctgatgggaccaggtccggatggactccctgccttaggctgacctgggagcggagccagttcgattcttggtcgggaattgtgaatggggatgttgcgacacccgcgcggtttgaaacgcccacccagactggaaggcctgattcccgagagcagaagaggctgggagcagaggtgagaaaacactgggaagctgccaattaagggacagaattttctagacatacaggtaaaataagatggttgtgaggcttctgagagaaacagaagacagctacctcagtgtggcagttttctagtccgggcgctcaatccctcaggcctgagtgcctgtctttggactccggtaggccacactctatccttatgagaaagccccgtttactttagttgactggagtgtggtctcagctcctgcagccagaaaagccctgactaaagcagagggcagggtggcacggcgagtgagttacgggacagggccctagcctaagcctcgtgctcagggctcattcctgcctctctgctacttttctagtaggcctccttcttggtccgcttggcccaaaaggcctcccaaatgctctgaaatagagctcatcaatagaaccttcacttgatttccctcttcttgggggaaactaagggcgccacccattaggaggtgccacctgcccccccccttttttttttttttttttgagagggagtttcgctcttgttgcccatgctggagtgcaatggcacgatcttggcccactgcaacctccatctcctgggttcaagcgatcttcccgcctcagccttccaagtagctgggattacagacgtgtgccatcaggcctggctaattttgtatttttagtagagacagggtttcgccatgttggtcaggatggtctcgaactcctgacctcaactgatccacccgcctcagcctcccaaagtgctaggattacaggtgtgagccactgcacccggccctgcccccagtcttgaccattctactaattttaaagaacatcttggaattttacactcttggaatcatagtcgtagaatcctttttttgagacagagtctcactctgtcgcccaggctggagtgcagtggccagatctcagctcactgaaacctcagcctcccaagttcaagtgattctcgtacctcagcctcctgagtagctggaattccaggctgtactcactgctttgctcatatcctcgctcattaccagggacaggccagcacccctgcattgcatctcacatatccactgatggatggagaacagactgaaattcagtgccttagagaccacacactccaaccccctcattgtgcagatgggaaaactgagagccatagaagggaagtggcttgcccaaagccacacttactgttttccccacactgtaccacaaactttcaccattcttcaggtttggaaaaatactaataaactgatcaacactaaa

SEQ ID NO: 190499 - DNA, 686 bp, Homo sapiens
  Payload ID: 17631
  Gene Name: tetratricopeptide repeat domain 22
  ENST ID: ENST00000448308
  CDS Start-End: 1-513
gagcagaagagactgcctgccttcaaccgcacgctggccctactccggcaagtgctgaagtccgaggacccccgccaccgagccctggcctggtgctacctcgggatgctgctggagcggaaggacaccttctccaccacccccatgggcgtccatgactgcgggtactcagggaccgaccctctagactgcttcggcaaggccattgagattgccaagaaccaacctcccatcctgaatcgcctggcaaaaatcttctacttcctgggaaagcaggatatggccattggaacctgcaacatggccctggatgtcctacgagatccagaactcaactggcaggcgtactgcacaagggccaagcttcccgcactggtcccagacctgcctcctagagcccacacagagcccatgtgcttgaggaagccgactcggagctcccagtttacttcactgcaagccgaagagtcctcccatcccctcatcttctccactactatccacatgacctagtggcaaatctactcccagtcttggtctcagtggcttaattactttgccagcaggtacgaggcaggagtgaaattccttcactgtcgtggatgtggttattattctagataataatgacattaaccataatagtaaataataaaatatctctataaaattctgcatttcatcaa

SEQ ID NO: 190500 - DNA, 3316 bp, Homo sapiens
  Payload ID: 17632
  Gene Name: tetratricopeptide repeat domain 23
  Uniprot ID: Q5W5X9
  ENST ID: ENST00000262074
  CDS Start-End: 219-1400
caggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatcttatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagggagaccttagtttcctgctctcagcgacacttccatagcctcatgatagctgcttggtgttctacagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccacgatgtcaacgaggagatccagtgccagatcgaggtggatggaacacccaggggtaggggtgcaggtgtgggcagtgatgtcccttcccctccctcccctggtcccacagactgtggccatgaggctgcaggctggtgctatgacagcagattgcagcacagggccctcccctccagcccccagtgggacatcaaaaccaccctggggccatttgtgcagggcaccacctccagtattgatggggaaaataaactcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtcactactcaccgtgtgtcctatctagttgacatgggtggagtcagctaaggggtgaatgttcatatgctcccaattcacgttgaagccctaatccccaaagggatggtattgggggtggggtcttggagaggtgattaggttatgagggtggagccctgatgaatgggattagtgctttataaggagagacaccagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgtt

SEQ ID NO: 190501 - DNA, 3849 bp, Homo sapiens
  Payload ID: 17632
  Gene Name: tetratricopeptide repeat domain 23
  Uniprot ID: Q5W5X9
  ENST ID: ENST00000394132
  CDS Start-End: 819-2162
aaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacggtgagcctctccagcagactgggtaaactggcaagggattttacgacatagttggagattggagagttacagaaacttttccggttttttacaagttttaaaggagtgattgagtgtcaaaggaaaagcagagaaaatacaggcacaatttaaagacagcaggaagaagagtgttcagagagcatttttctctttagggtgaagtttgaaagcatcatgcccagattatcagtggatttttgaaagatggagtctcgctctgtcacccaggctggagtatagtggtgtgatcttggctcactgcaacctctgcctcccaggttcaagcgattctcctgcctcagcctctcgagtagctggaattacaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaagacagagttttgccatgttgcccaggctggtcccaaactcctgagctgaggtgaccctcccgcctccacctcccagagtgctgggattacagaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatcttatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccacgatgtcaacgaggagatccagtgccagatcgaggtggatggaacacccaggggtaggggtgcaggtgtgggcagtgatgtcccttcccctccctcccctggtcccacagactgtggccatgaggctgcaggctggtgctatgacagcagattgcagcacagggccctcccctccagcccccagtgggacatcaaaaccaccctggggccatttgtgcagggcaccacctccagtattgatggggaaaataaactcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtcactactcaccgtgtgtcctatctagttgacatgggtggagtcagctaaggggtgaatgttcatatgctcccaattcacgttgaagccctaatccccaaagggatggtattgggggtggggtcttggagaggtgattaggttatgagggtggagccctgatgaatgggattagtgctttataaggagagacaccagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgtta

SEQ ID NO: 190502 - DNA, 2496 bp, Homo sapiens
  Payload ID: 17632
  Gene Name: tetratricopeptide repeat domain 23
  Uniprot ID: Q5W5X9
  ENST ID: ENST00000394135
  CDS Start-End: 719-2062
actcttgcttccggctccggcgtggggtttgatgtcgacggagtggcttttgcttagcgtcttgaaggggggaaaaaaatcctctaagctggtgatttcacgttctttgacaaacttcaatatcaacaggcaacgataccactttaagaaaattccaaggaaaagacctcattttaaaattcccacctctggctcccaaagattggtttgcaaacttcgacaaaatactcttctccactcgctattggtgagtgctctatcattcattcttttgcctggagttttgtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacggtgagcctctccagcagactgggtaaactggcaagggattttacgacatagttggagattggagagttacagaaacttttccggttttttacaagttttaaaggagtgattgagtgtcaaaggaaaagcagagaaaatacaggcacaatttaaagacagcaggaagaagagtgttcagagagcatttttctctttagggtgaagtttgaaagcatcatgcccagattatcagtggatttttgaaagaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatcttatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataa

SEQ ID NO: 190503 - DNA, 844 bp, Homo sapiens
  Payload ID: 17632
  Gene Name: tetratricopeptide repeat domain 23
  ENST ID: ENST00000434594
  CDS Start-End: 1-790
agtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaaggctataacaagggccacatttaaaaatagaaactggagcccatcctctgatccctcagaacatccaaaccaaaggtcagtcactaggagacatcccaggagcatgctaattccatcacagcagggcctaagaatgaggtcatctttctctcattcaagggagaccttagtttcctgctctcagcgacacttccatagcctcatgatagctgcttggtgttctacagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacct

SEQ ID NO: 190504 - DNA, 3538 bp, Homo sapiens
  Payload ID: 17632
  Gene Name: tetratricopeptide repeat domain 23
  Uniprot ID: Q5W5X9
  ENST ID: ENST00000459771
  CDS Start-End: 440-1621
tggttatcaatctgtacaaagaatcaccaaactgataaagcaggaaccagagggcaaatcacgctgccaagacaactgtgtaattcgctcgaaaaagaaacgatggagtctcgctctgtcacccaggctggagtatagtggtgtgatcttggctcactgcaacctctgcctcccaggttcaagcgattctcctgcctcagcctctcgagtagctggaattacaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatcttatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagggagaccttagtttcctgctctcagcgacacttccatagcctcatgatagctgcttggtgttctacagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaagggaaacctgaacacgctgctgtcagcatgtgttttcaaagtgcagcctgcctcagagttcttcggagcctgaaaaggggtttgagaaagagcccagtaggaggggcaggaggccgacacacctgacttggcctggggcccaggaggcaggtgtaagggagtgaaaagaaaggctagccggaggctgcggggggaagaccgcagactccctgctgcttcgcatccctcctgtggcctccactgcaggcaggacaaacctggatgccacctggagctgcttcctgagttggcacactatcgtgtacacagcagtcttcagccccctggaaggaggccatagtcgtgtgaggatggcaaagtcgaacaggaagctttgagtgccttcctccacgatgtcaacgaggagatccagtgccagatcgaggtggatggaacacccaggggtaggggtgcaggtgtgggcagtgatgtcccttcccctccctcccctggtcccacagactgtggccatgaggctgcaggctggtgctatgacagcagattgcagcacagggccctcccctccagcccccagtgggacatcaaaaccaccctggggccatttgtgcagggcaccacctccagtattgatggggaaaataaactcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtcactactcaccgtgtgtcctatctagttgacatgggtggagtcagctaaggggtgaatgttcatatgctcccaattcacgttgaagccctaatccccaaagggatggtattgggggtggggtcttggagaggtgattaggttatgagggtggagccctgatgaatgggattagtgctttataaggagagacaccagagagatgatctctctctccaccatgtgaggacacagtgagaagacagccgtctgcaggcccggaagagagccctcaccaggaaatgaaactgttggcaccttgagacttcccagcttccagaactgtaagaaataaatgtttgttgtttaagcctttcaggctacggctttctgttacagcagcctgaactgagagtccatgccgagtttttgaaataaatgtgaattctgatgtta

SEQ ID NO: 190505 - DNA, 776 bp, Homo sapiens
  Payload ID: 17632
  Gene Name: tetratricopeptide repeat domain 23
  ENST ID: ENST00000480371
  CDS Start-End: 1-220
aaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagaatctcaagagaaagctggttctagaaggttctgtgtaaccttctctggaatgttttgctgacttcccataacttgcataaaggacaagttcctttgaaacccgagttgtaaaagatcttccttgcccagggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagt

SEQ ID NO: 190506 - DNA, 581 bp, Homo sapiens
  Payload ID: 17632
  Gene Name: tetratricopeptide repeat domain 23
  ENST ID: ENST00000560235
  CDS Start-End: 422-581
ttagactttttcatggttatcaatctgtacaaagaatcaccaaactgataaagcaggaaccagagggcaaatcacgctgccaagacaactgtgtaattcgctcgaaaaagaaacggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaacagagttttgccatgttgcccaggctggtcccaaactcctgagctgaggtgaccctcccgcctccacctcccagagtgctgggattacagaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagt

SEQ ID NO: 190507 - DNA, 2068 bp, Homo sapiens
  Payload ID: 17632
  Gene Name: tetratricopeptide repeat domain 23
  Uniprot ID: Q5W5X9
  ENST ID: ENST00000558663
  CDS Start-End: 268-1611
actcttgcttccggctccggcgtggggtttgatgtcgacggagtggcttttgcttagcgtcttgaaggggggaaaaaaatcctctaagctggtgatttcacgttctttgacaaacttcaatatcaacaggcaacgataccactttaagaaaattccaaggaaaagacctcattttaaaattcccacctctggctcccaaagattggtttgcaaacttcgacaaaatactcttctccactcgctattgaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatcttatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaagtgtctccagatccagaccctcttatatggaccgcaggacaaaaggactctggccacccagcaggccatgggcatgctgtccacggcccccaaggttgcttcgaagccaaggcaggcatcaaaagccaaagtggccttctgcaccagcatccctcaggacaccctgctggggaaggcccggcccggcacaacagcagactgaggcccccaccctgaaaaagcctaggacattcctgggcactgtcatttagggtgctgtacaaatcacctccgcctagaaaatggaattcaacagtcaggatacagatttccaaggccaactgttggccccaacatgcaacagtgagaccataagcctcccgtgggccacattttgacagtggatgcccttcagggtgatatatgctataaagcagttttctatcacctaagtggtttttcttgccaacaagaatttttacccatcagcactactgtggctgaaaaacttctcttcaacagttcagtgcgccctgtgcaggagtcagcccggcatctgcttgtacacacagctccttgcataggtgtggagttagatctggacagtgaacttcaggaagtcctttcttataggaggctaatagggattgagaataacatgagaagaaaacgctaataaa

SEQ ID NO: 190508 - DNA, 549 bp, Homo sapiens
  Payload ID: 17632
  Gene Name: tetratricopeptide repeat domain 23
  ENST ID: ENST00000560860
  CDS Start-End: 205-549
cttttgcctggagttttgtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacgaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccaga

SEQ ID NO: 190509 - DNA, 574 bp, Homo sapiens
  Payload ID: 17632
  Gene Name: tetratricopeptide repeat domain 23
  ENST ID: ENST00000558078
  CDS Start-End: 407-574
attcattcttttgcctggagttttgtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattcc

SEQ ID NO: 190510 - DNA, 585 bp, Homo sapiens
  Payload ID: 17632
  Gene Name: tetratricopeptide repeat domain 23
  ENST ID: ENST00000560772
  CDS Start-End: 337-585
atcattcattcttttgcctggagttttgtgaggtacccgcttgctttatgggaaaaggctgctccggaactgccctactttagactttttcatggttatcaatctgtacaaagaatcaccaaactgataaagcaggaaccagagggcaaatcacgctgccaagacaactgtgtaattcgctcgaaaaagaaacgatggagtctcgctctgtcacccaggctggagtatagtggtgtgatcttggctcactgcaacctctgcctcccaggttcaagcgattctcctgcctcagcctctcgagtagctggaattacagaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacat

SEQ ID NO: 190511 - DNA, 666 bp, Homo sapiens
  Payload ID: 17632
  Gene Name: tetratricopeptide repeat domain 23
  ENST ID: ENST00000560279
  CDS Start-End: 212-666
actcttgcttccggctccggcgtggggtttgatgtcgacggagtggcttttgcttagcgtcttgaagggatggagtctcgctctgtcacccaggctggagtatagtggtgtgatcttggctcactgcaacctctgcctcccaggttcaagcgattctcctgcctcagcctctcgagtagctggaattacagaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaa

SEQ ID NO: 190512 - DNA, 560 bp, Homo sapiens
  Payload ID: 17632
  Gene Name: tetratricopeptide repeat domain 23
  ENST ID: ENST00000561365
  CDS Start-End: 90-560
actcttgcttccggctccggcgtggggtttgatgtcgacggagtggcttttgcttagcgtcttgaagggaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgca

SEQ ID NO: 190513 - DNA, 2505 bp, Homo sapiens
  Payload ID: 17632
  Gene Name: tetratricopeptide repeat domain 23
  Uniprot ID: Q5W5X9
  ENST ID: ENST00000394129
  CDS Start-End: 579-1754
gcttccggctccggcgtggggtttgatgtcgacggagtggcttttgcttagcgtcttgaaggggggaaaaaaatcctctaagctggtgatttcacgttctttgacaaacttcaatatcaacaggcaacgataccactttaagaaaattccaaggaaaagacctcattttaaaattcccacctctggctcccaaagattggtttgcaaacttcgacaaaatactcttctccactcgctattgatggagtctcgctctgtcacccaggctggagtatagtggtgtgatcttggctcactgcaacctctgcctcccaggttcaagcgattctcctgcctcagcctctcgagtagctggaattacaggtctggcagaaggaacagtatcaactgactgagtaggtctcattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatatgcaagaatcacaggaaacccacatatccaaccacctagatgaagttgttgctgctgttagcatcactcatagaaagaagttccaaaacaagctgcttcagacagcactattccagcctcctcgagagaaactccacctctgtgaagagaaagcaaagtcctattccaacagtcatgagtacaaacaggccgtccatgagcttgtgcgttgcgtagcactgacaagaatttgctatggagactcacattggaaactagcagaggcacatgttaatctggctcaaggctacctccagctgaaaggactgtcactgcaagcaaaacaacatgcagaaaaagccagacaaatcctcgccaactccattgtgcctccctatagtgagaatacagatgttttcaagttttccattgagcttttccataccatgggcagagctttactctcccttcaaaaatttaaggaagctgcagagaatttgacaaaagcagagagactttcaaaggagctgctacaatgtggaagaattataaaggaagaatggatagaaattgaagcacggatcagattatcatttgcacaggtgtatcaaggtcagaagaagtcaaaagaagctttgtcccactatcaagcagctttggaatatgttgagatcagtaaaggtgaaacaagtcgtgagtgtgtacccatattgagagaattagcaggtgtagagcaagccctgggactccacgatgtatccatcaaccacttcctccaggcacatcttatcatcctgagtagaagcccctctcaagtggaggcagcagactcggcacacatcgtcgcccatgctgctgtcgcttcagggagacacgagcaccatgatgtagctgagcagtattttcaagagagcatggctcatcttaaggattctgaagggatgggaagaaccaaatttctttcaattcaagatgaattttgccattttctacaaatgactggacaaaaagagagagcaacctcgatcctgagagagtccctggaagccaaagtggaagcatttggcgatttcagtcccgaggtggcagagacataccggctcctgggaggagcagacctggcgcaggggaaccacagtggggcccgcaagaaactgaagaaggtaaagctggaaccagtactaacacgagactaggctctccctcccctctccaaggtcaatttctctcccttgtggtggttcttttaaatgaaactttagaagtggcttgtttagataggatgacatcacttttgtggtagatctaacctgatactttttgggtaaaagacatagtaagcctcttagacatacatattttttaaatgaattatcagtttttactatgcaaatatttttaattttttacgtagtacaattgatcagtcctttatgtttgcggtgctctctctatactgagtttatagaggaattctcttacactttcttcaattgtcattcttctttaaatttggagtttatttgtgtggatggcatgaggaatggatctaatcttaccttttttccaaatggccacccagttgtccagcaccatttaattagagagcccatctatgctccagtgacttcagataacaccttcatcatatactgattttccttatggacttaagtctatttctagatttctcttctcttccactagtctttctgtttattcatgtgtcaatatttcagttttaattacagagattttatagaatgatttaatatgtgataggagtagacaccccttatggcttttcttttactagaatatcaggtgttctagctattcttccgtgtttatttttctacatgaatttttgtatcaatttgtctaactccataaagagcttactagtatttttattgcattatttataaataaatcttgtgagaattg

SEQ ID NO: 190514 - DNA, 1353 bp, Homo sapiens
  Payload ID: 17633
  Gene Name: tetratricopeptide repeat domain 23-like
  Uniprot ID: Q6PF05
  ENST ID: ENST00000505624
  CDS Start-End: 104-1189
attgtctccttggccggacctgggctgcggaaggtaactggggacgtcgcaggctgtgcagctttcgcgaggcaccgctttggcgcccggaccgaggaagaagatgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatgaatactcaagcaaacaaggagctgattcgatgtgtcatcctttctcggattatttttggggaccatcactggaaatgtgcacgagctctggccaacctagcttatggctacttgacactgagaggcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcaggctcattctgtctgtgtttctttgttcactgaagtcagccccaaaactgcagaaatgagtgcgttactggccaaagcttatgccatgtctggagaggcccagcacagggatgctgttgagatatatttcataagaagtatcaatgcatatcgagcaacattgggctcagaggattttgaaacactgagcaccactgaagaattttgcaaatggcttgtccaaaatggagaaaaacaggacaagtagcagttcatccagatggagaagagaagccattcctggaagaaggaactctacatacaaaggcacagaagcatgacagagggcagtgtatggaggaatggtcttctgttatcaaattgaaaacctctatacaggatagccaacaataaagacaaccttgttgatga

SEQ ID NO: 190515 - DNA, 3410 bp, Homo sapiens
  Payload ID: 17633
  Gene Name: tetratricopeptide repeat domain 23-like
  ENST ID: ENST00000508722
  CDS Start-End: 102-251
tgtctccttggccggacctgggctgcggaaggtaactggggacgtcgcaggctgtgcagctttcgcgaggcaccgctttggcgcccggaccgaggaagaagatgcaagccagccccatccgtatcccaactgttagcaatgacatcgactgggatttctgcttccatatgcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcaggtcagtgggttggccagagcccaggctgggttgccttgtttggccccaggcttggttctcagggccagggaagcatgggcttctcagaagaacaagggctggaattgattctgttttaaccctgactttcctccagatccacctaagagcccttgatcaaaccttaaatgaccaggccagagaacactgactcaggtgggcgaatgtgctgtgtcattggctgtgcagacagcacttccccctccccctcttatctctgttggtgctgtaaaaaagaagcaaaatgtgagtctactccaaggaaaaaagatacagggacaaccgaacttaaatcttcagcaaaaacaaaaggcctttttaaatgaaaaatcatggtattttagggtaatgctgtcatttgtactttaaactagtctagctgattatatttccaaacctaaggttaaactaacaaaagggtgtttcacttggaggtaactaacttgacaaatgcccgggggaaaacaaaacaaaacataggaaggaatggtgagtctattatattagggtacttttatgtatcatgtacttgaagctgctaaattcaccttttctctctccgaaggagaatgctgcctgtggcttcaggtatctcccacagtgacaaacatcaaaatactggatatcctgtatcatagaaaaggtgcaatgcaatctaacagtatacatgaaaacagactctgaagaaaaggcattgcaaacaatctgacagtccacaattataaacatcacacagtggagagatgtcagagaatgctgctgtgaaggcagggagtccactgcttacagagaaagccagtctggtttttgtgttcaagactttctcaaagcagtggtcagatcagaatgaataaaacaataaatagcagtgtttcccaaaagcaccaaaagataagagttaaaatgtatggaatgctttttctacgttccctagaggatatatcgattcatttaatctgtacaatagctctatgaagtaggtaccattattattttatctcattttaaggatgagaaaactgacgcacagagttatagctaactcagctgacattgtatagctaagaaatagtaaagcagggatttgaactccacatctgaccctacagcctgtattcataacaactctgctctgtgtcttggctccaaagtcttctctgataacccctcagctctttgaaacacctcacagtatttggcctatgaaatattaagcacaggtggttcttttgtggctggtgggtgtggactcaatgtttttctctttctcttttctaagtgttactccttccattttagcacaaataatataaaatctaacacttttttagtgcttactatatgctgggtggtgttctaaccactttacatatattaaccattaatttatttaatatttacaacaactttttataacaaatactattcttattatccctgatttacatttacaagactgccttcaagactggagttcagtccagtgagactgagctaaggttatgactttatttttgctatgaaatctaataaaaattatactagccaacatttattgagaacttaccacgtgatgagcaccgtgccctgtgctttgcatataccatctcacttaatccttcccaaaccctaatcagtgggaattatatattccttctacgaatgaaggtgaaattacttgcacaagactcatagctaggaagtggcagagctgggactcaaactcacctctcatctaaatccacagtgaacactgtcattgggtgcttaccttgtcatgattttctttattccaggctcattctgtctgtgtttctttgttcactgaagtcagccccaaaactgcagaaatgagtgcgttactggccaaagcttatgccatgtctggagaggcccagcacaggggtaggtaaaagaggtagccttgaagttatttcccagtcacatgagggaagcacattggcaaacagcctatctaagattctaattagctatttattcctgtaatggaaaaattaggtgggtcacagtctcatacaaaatcaattacacattaatttaaacctgataatatacccccacattcgttggaatgtcagtaacaaataaatcatctgatttctacatcctctatttattttgaatctcagtgagattcaccttcttaactaatagatatcacacatactgtgaatgtggcctgtgcagtatcggttgataaggacatccagtgataaatgggtagagctttacctcctccactttcagtctccttgactcttttcctctggctgacaagagagaatgtttgttagcagaattttcttgacccatattcaatagttagatactgggggttgcagagaaagccaactgattaatttatgcttcaacaatagttctttgtctggcaaggtcatctttttgaaagtgggtggctttgggagagacacaaatgaaccaatgagggaggacaatgtatcattctgtgctggcttgatcagattaatggacactgatggattcagtggcctgtcaggaggaatttaggcttcatgaagaatataatttgatcattttaaaactgtctattttctttgcttataaaagtaacctttttgtgtatgttattttccagttagagagagggacagaattatagagaaagctttccatcctacttttttcaatgcttgtattccccatgtcattaaataaacattttttttcagtttgcaaaa

SEQ ID NO: 190516 - DNA, 977 bp, Homo sapiens
  Payload ID: 17633
  Gene Name: tetratricopeptide repeat domain 23-like
  Uniprot ID: Q6PF05
  ENST ID: ENST00000502674
  CDS Start-End: 1-864
atgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatgaatactcaagcaaacaaggagctgattcgatgtgtcatcctttctcggattatttttggggaccatcactggaaatgtgcacgagctctggccaacctagcttatggctacttgacactgagaggcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcagatgctgttgagatatatttcataagaagtatcaatgcatatcgagcaacattgggctcagaggattttgaaacactgagcaccactgaagaattttgcaaatggcttgtccaaaatggagaaaaacaggacaagtag

SEQ ID NO: 190517 - DNA, 973 bp, Homo sapiens
  Payload ID: 17633
  Gene Name: tetratricopeptide repeat domain 23-like
  Uniprot ID: Q6PF05
  ENST ID: ENST00000610313
  CDS Start-End: 1-864
atgcaagccagccccatccgtatcccaactgttagcaatgacatcgactgggatttctgcttccatatgtcacagcaaaccgagatcccagctcaccagcaaacagatgagttgtatcccactggtgggtgtggagagagtgaagaggaaactaaagctaaagagaaggagaaggccatagactgtatgtctcatcccaaagagaaattagcccaatcccagaagaaagtagctcagctgattaaggaaaaaatgaatactcaagcaaacaaggagctgattcgatgtgtcatcctttctcggattatttttggggaccatcactggaaatgtgcacgagctctggccaacctagcttatggctacttgacactgagaggcctcccagttcaggccaagaaacatgctacatcagccaagaatacactgttgacctggaaggcaaatacgacctcaaataaggagaaagaggaaatcctggaagctctggtcaagctgtactacactctgggcgtggcctggctcctgcagaaccgtggcagagaagcctatttcaacctgcagaaggcagagagaaacatgaaggagctgaaagaattatataaaggaggtgtttgtgaattacaagtctctgagaacgacctaacacttgctttgggcagagcctccttggccatccacagactgaacctagctctggcatactttgaaaaggcaattggcgatgttattgctgccaagggtgataggacgtcagatctgatcagcctgtacgaggaagctgctcagatagagcagctgaggaggaaccacaaccaggccatccagtacttgcagcagatgctgttgagatatatttcataagaagtatcaatgcatatcgagcaacattgggctcagaggattttgaaacactgagcaccactgaagaattttgcaaatggcttgtccaaaatggagaaaaacaggtaaa

SEQ ID NO: 190518 - DNA, 2005 bp, Homo sapiens
  Payload ID: 17634
  Gene Name: tetratricopeptide repeat domain 24
  Uniprot ID: A2A3L6
  ENST ID: ENST00000368236
  CDS Start-End: 37-1785
cagagagccagctgcggagaagacccaaggagccctatgtcttcccccaaccctgaggatgtgccccggaggccagaacctgagccctcaagctccaataagaaaaagaagaaaagaaagtggctgcggcaagaagccagcatccaagccctcaccagggctggccatggggcccttcaggctggccagaaccatgaagccttgaacaacttccagagggccttccttctggcctccaaggccccacaaaccagggatacccctgtgctccaggcctgcgccttcaacctgggggctgcctatgtggagactggggacccagccagaggccttgagctactcctgcgagcccaccctgaagagaaggcacagggcaggcgacacggcgaccaatgtttcaatgtggctttggcctaccatgccctcggcgagctgcctcaagctttggcctggtaccacagggccctgggccactaccagccacagggtgaccagggagaagcctgggcaaaaatgggagcctgctaccaggctctgggacagcctgagctagcagcccactgcctgcaggaagcaagccaggcctatgctcaagagagacagctgcgggccgcagccctggcactgggggctgcggcaggatgtatgctgaagagtgggcggcatcgggtgggggaagttgtgcaggtgctggagaaaagccggaggcttgccgagaggagcactgagaggcgactgctggggcacctctataacgatctaggcctgggctactcccagctccagctgttcccgctggccgtggaggccttcctgcaggccctgcccctgtgctgggtgccaggagagcaggccacagtgctaagaaacctcgggatggcccacaatgccctcggcaactatcaggaagctcgggagtttcaccagaaggctgctgacctacacggctctgtggggcagcggtgggagcagggccggagctttggcagcctggcctttgcattgagccagctgggggaccacaaggctgccagagacaactacctgcatgccctgcaggctgcccgggactctggggacatgaagggacagtggcaggcctgtgagggtctgggggctgctgcagccaggctggggcagtatgaccaggccttgaagtactataaggaagcactggcccagtgtcagaaggagccagattctgtgcgagaacggctggtggccaagctggcagacaccgtgaggacgcgcttggcccaggtggggctggtccagactcacaccctgacttcggctccgggaagactccaggctccaggtggggccagccaggcggaggggaccccagcaaaggcaggaagcagcacagcaggtgtccagcacagatcttccagtgggtgggaagatgaagagtttgaggagggccaccagaagaaaaaagaggagaggtcggcaaacgttccggtgagggctgggccgggaagaccagagctgtgtttccttccaggcacagtgaatcattcgcaccatctagcttctagttgccccacgtttaccaagcacacgccctgcagagggacagtcctcggcaaagcctccatctatagtccaggacccagggcccatcttccatttgtaggtccaggccctcccagagcggagtaccctagcatcttggtacccaatggccctcaagccaataggtcatccaggtggcccagggaaagcctcagcaggagccgccagaggagacccatggagtcgggcatctgcactattgtgtgacctccccctgccagcctcagccctcatccctgaagcacctgtccaacacgcacacactagggggtcctggggaccaagcctcttcccagttgctcagccctgcagggatgtggaacacagtgcagccagtggactcctgaggaggctggccaagggctttgcaggctcggccctgagaggttctgtttgttcctccttgggatttttggactcagtaggt

SEQ ID NO: 190519 - DNA, 1969 bp, Homo sapiens
  Payload ID: 17634
  Gene Name: tetratricopeptide repeat domain 24
  Uniprot ID: A2A3L6
  ENST ID: ENST00000368237
  CDS Start-End: 1-1749
atgtcttcccccaaccctgaggatgtgccccggaggccagaacctgagccctcaagctccaataagaaaaagaagaaaagaaagtggctgcggcaagaagccagcatccaagccctcaccagggctggccatggggcccttcaggctggccagaaccatgaagccttgaacaacttccagagggccttccttctggcctccaaggccccacaaaccagggatacccctgtgctccaggcctgcgccttcaacctgggggctgcctatgtggagactggggacccagccagaggccttgagctactcctgcgagcccaccctgaagagaaggcacagggcaggcgacacggcgaccaatgtttcaatgtggctttggcctaccatgccctcggcgagctgcctcaagctttggcctggtaccacagggccctgggccactaccagccacagggtgaccagggagaagcctgggcaaaaatgggagcctgctaccaggctctgggacagcctgagctagcagcccactgcctgcaggaagcaagccaggcctatgctcaagagagacagctgcgggccgcagccctggcactgggggctgcggcaggatgtatgctgaagagtgggcggcatcgggtgggggaagttgtgcaggtgctggagaaaagccggaggcttgccgagaggagcactgagaggcgactgctggggcacctctataacgatctaggcctgggctactcccagctccagctgttcccgctggccgtggaggccttcctgcaggccctgcccctgtgctgggtgccaggagagcaggccacagtgctaagaaacctcgggatggcccacaatgccctcggcaactatcaggaagctcgggagtttcaccagaaggctgctgacctacacggctctgtggggcagcggtgggagcagggccggagctttggcagcctggcctttgcattgagccagctgggggaccacaaggctgccagagacaactacctgcatgccctgcaggctgcccgggactctggggacatgaagggacagtggcaggcctgtgagggtctgggggctgctgcagccaggctggggcagtatgaccaggccttgaagtactataaggaagcactggcccagtgtcagaaggagccagattctgtgcgagaacggctggtggccaagctggcagacaccgtgaggacgcgcttggcccaggtggggctggtccagactcacaccctgacttcggctccgggaagactccaggctccaggtggggccagccaggcggaggggaccccagcaaaggcaggaagcagcacagcaggtgtccagcacagatcttccagtgggtgggaagatgaagagtttgaggagggccaccagaagaaaaaagaggagaggtcggcaaacgttccggtgagggctgggccgggaagaccagagctgtgtttccttccaggcacagtgaatcattcgcaccatctagcttctagttgccccacgtttaccaagcacacgccctgcagagggacagtcctcggcaaagcctccatctatagtccaggacccagggcccatcttccatttgtaggtccaggccctcccagagcggagtaccctagcatcttggtacccaatggccctcaagccaataggtcatccaggtggcccagggaaagcctcagcaggagccgccagaggagacccatggagtcgggcatctgcactattgtgtgacctccccctgccagcctcagccctcatccctgaagcacctgtccaacacgcacacactagggggtcctggggaccaagcctcttcccagttgctcagccctgcagggatgtggaacacagtgcagccagtggactcctgaggaggctggccaagggctttgcaggctcggccctgagaggttctgtttgttcctccttgggatttttggactcagtaggt

SEQ ID NO: 190520 - DNA, 1984 bp, Homo sapiens
  Payload ID: 17635
  Gene Name: tetratricopeptide repeat domain 25
  ENST ID: ENST00000591658
  CDS Start-End: 80-1228
ggagcttccacaaaccagatagaggttctccagcttttctttgattgtctctgctttagcgtctctaaatccggtcaccatgtcggaccccgaaggcgagaccttgcgaagcacctttccctcttatatggccgaaggcgagcggctctacctgtgcggggaattttctaaagccgcgcagagcttcagcaacgctctttaccttcaggatggagacaagaactgcctggttgctcgctcaaagtgcttcctgaagatgggagacttggagagatccctgaaggatgctgaggcttcgctccagagtgacccagctttctgtaaggggattttgcaaaaggctgagacactgtacaccatgggagactttgagtttgccttggtattctatcatcgaggctacaagctgaggcctgatcgggaattcagagttggcattcagaaagcccaggaagccatcaacaactcagtgggaagtccttcttccattaagctggagaacaaaggggacctctccttcttaagcaagcaggctgagaatataaaagcccagcagaagcctcagcccatgaaacacctcttacaccccaccaagggagagcccaagtggaaggcctcgctcaagagtgagaagactgtccgccagcttctgggggagctctacgtggacaaagagtatttggagaagctcctattggatgaagacctgatcaaaggcaccatgaagggcggcctgactgtggaggacctcatcatgacgggcatcaactacctggatactcacagcaacttctggaggcagcagaagccgatctacgccagggagcgggaccggaagctgatgcaagagaaatggctgcgggaccacaaacgccgtccctcacagacagcccattacatcctcaagagcctggaggacattgatatgttgctcacaagtggcagtgctgaagggagtcttcagaaagctgagaaagtgctgaagaaggtactggaatggaacaaggaagaggtacccaacaaggatgaactggttggaaacttgtatagctgcatagggaatgcccagattgagctggggcagatggaggcagccctgcagagccacagaaaggacctggagatcgccaaggaatatgaccttcctgatgcaaaatcgagagcccttgacaacattggcagagtttttgccagagttgggaaattccagcaagccattgacacgtgagtgaccaagaattgcctcttccccacctccatggccttggacgatgccaacaagggtatcatcagagaactgaggaaaaccaactacgtggagaatctcaaagaaaaaagcgagggagaagcttcactgtatgaagatagaataataacaagagagaaggacatgaggagagtgagagatgagcccgagaaggtggtgaagcagtgggaccatagtgaggatgagaaagagacagatgaggacgatgaggcttttggggaagctctgcagagcccagcaagcggaaagcagagtgtggaagcaggaaaagccagaagcgatttgggagcagttgccaagggcctgtcaggagaattaggcacaagatcaggagaaacaggcaggaagctactagaagctggcagaagagagtcaagagaaatttataggaggccttcgggagaattagagcaaagactctcaggagaattcagcagacaggaaccagaagaactaaagaaactttcagaagtgggcagaagagagccagaagaactgggaaaaacacaatttggagaaataggagaaacgaaaaaaacaggaaatgagatggaaaaggaatatgaatgaagccatcggtagagatgaggatcaggaagctggtgttcagagggatcatgggattttattaaactggattttcaagcgatttgtctgttataggaaaaatgagggttttacttctgctgctttccatcactattttgccattaaata

SEQ ID NO: 190521 - DNA, 2255 bp, Homo sapiens
  Payload ID: 17635
  Gene Name: tetratricopeptide repeat domain 25
  Uniprot ID: Q96NG3
  ENST ID: ENST00000377540
  CDS Start-End: 69-2087
aaaccagatagaggttctccagcttttctttgattgtctctgctttagcgtctctaaatccggtcaccatgtcggaccccgaaggcgagaccttgcgaagcacctttccctcttatatggccgaaggcgagcggctctacctgtgcggggaattttctaaagccgcgcagagcttcagcaacgctctttaccttcaggatggagacaagaactgcctggttgctcgctcaaagtgcttcctgaagatgggagacttggagagatccctgaaggatgctgaggcttcgctccagagtgacccagctttctgtaaggggattttgcaaaaggctgagacactgtacaccatgggagactttgagtttgccttggtattctatcatcgaggctacaagctgaggcctgatcgggaattcagagttggcattcagaaagcccaggaagccatcaacaactcagtgggaagtccttcttccattaagctggagaacaaaggggacctctccttcttaagcaagcaggctgagaatataaaagcccagcagaagcctcagcccatgaaacacctcttacaccccaccaagggagagcccaagtggaaggcctcgctcaagagtgagaagactgtccgccagcttctgggggagctctacgtggacaaagagtatttggagaagctcctattggatgaagacctgatcaaaggcaccatgaagggcggcctgactgtggaggacctcatcatgacgggcatcaactacctggatactcacagcaacttctggaggcagcagaagccgatctacgccagggagcgggaccggaagctgatgcaagagaaatggctgcgggaccacaaacgccgtccctcacagacagcccattacatcctcaagagcctggaggacattgatatgttgctcacaagtggcagtgctgaagggagtcttcagaaagctgagaaagtgctgaagaaggtactggaatggaacaaggaagaggtacccaacaaggatgaactggttggaaacttgtatagctgcatagggaatgcccagattgagctggggcagatggaggcagccctgcagagccacagaaaggacctggagatcgccaaggaatatgaccttcctgatgcaaaatcgagagcccttgacaacattggcagagtttttgccagagttgggaaattccagcaagccattgacacgtgggaagaaaagatccctctggcaaaaaccaccctggagaagacctggctgttccacgagatcggccgctgctacttggagctggaccaggcctggcaggcccagaattatggcgagaagtcccagcagtgtgccgaggaggaaggggacattgagtggcaactgaatgccagtgttctggtggcccaggcacaagtgaagctgagagacttcgagtcagccgtgaacaattttgagaaggccctggagagagcaaagcttgtgcataacaacgaggcgcagcaggccatcatcagtgccttggacgatgccaacaagggtatcatcagagaactgaggaaaaccaactacgtggagaatctcaaagaaaaaagcgagggagaagcttcactgtatgaagatagaataataacaagagagaaggacatgaggagagtgagagatgagcccgagaaggtggtgaagcagtgggaccatagtgaggatgagaaagagacagatgaggacgatgaggcttttggggaagctctgcagagcccagcaagcggaaagcagagtgtggaagcaggaaaagccagaagcgatttgggagcagttgccaagggcctgtcaggagaattaggcacaagatcaggagaaacaggcaggaagctactagaagctggcagaagagagtcaagagaaatttataggaggccttcgggagaattagagcaaagactctcaggagaattcagcagacaggaaccagaagaactaaagaaactttcagaagtgggcagaagagagccagaagaactgggaaaaacacaatttggagaaataggagaaacgaaaaaaacaggaaatgagatggaaaaggaatatgaatgaagccatcggtagagatgaggatcaggaagctggtgttcagagggatcatgggattttattaaactggattttcaagcgatttgtctgttataggaaaaatgagggttttacttctgctgctttccatcactattttgccattaaataggtgtctttcactcttgcaaa

SEQ ID NO: 190522 - DNA, 466 bp, Homo sapiens
  Payload ID: 17635
  Gene Name: tetratricopeptide repeat domain 25
  ENST ID: ENST00000585530
  CDS Start-End: 1-63
tccctgaaggatgctgaggcttcgctccagagtgacccagctttctgtaaggtcattgcctaagtccctgccccctgtattccaaccttgaccttcaacccaggacccttctgttccaccacatgtccttcttccattaagctggagaacaaaggggacctctccttcttaagcaagcaggctgagaatataaaagcccagcagaagcctcagcccatgaaacacctcttacaccccaccaagggagagcccaagtggaaggcctcgctcaagagtgagaagactgtccgccagcttctgggggagctctacgtggacaaagagtatttggagaagctcctattggatgaaggtttcggacactttgttggcacggggccttgggggaaaggaaatctgggtggatgcttcatgcatgagctgaaggcagaacctgtcatataatattagctgacgtgtacctgtg

SEQ ID NO: 190523 - DNA, 2242 bp, Homo sapiens
  Payload ID: 17635
  Gene Name: tetratricopeptide repeat domain 25
  ENST ID: ENST00000617460
  CDS Start-End: 61-2055
tagaggttctccagcttttctttgattgtctctgctttagcgtctctaaatccggtcaccatgtcggaccccgaaggcgagaccttgcgaagcacctttccctcttatatggccgaaggcgagcggctctacctgtgcggggaattttctaaagccgcgcagagcttcagcaacgctctttaccttcaggatggagacaagaactgcctggttgctcgctcaaagtgcttcctgaagatgggagacttggagagatccctgaaggatgctgaggcttcgctccagagtgacccagctttctgtaaggggattttgcaaaaggctgagacactgtacaccatgggagactttgagtttgccttggtattctatcatcgaggctacaagctgaggcctgatcgggaattcagagttggcattcagaaagcccaggaagccatcaacaactcagtgggaagtccttcttccattaagctggagaacaaaggggacctctccttcttaagcaagcaggctgagaatataaaagcccagcagaagcctcagcccatgaaacacctcttacaccccaccaagggagagcccaagtggaaggcctcgctcaagagtgagaagactgtccgccagcttctgggggagctctacgtggacaaagagtatttggagaagctcctattggatgaagacctgatcaaaggcaccatgaagggcggcctgactgtggaggacctcatcatgacgggcatcaactacctggatactcacagcaacttctggaggcagcagaagccgatctacgccagggagcgggaccggaagctgatgcaagagaaatggctgcgggaccacaaacgccgtccctcacagacagcccattacatcctcaagagcctggaggacattgatatgttgctcacaagtggcagtgctgaagggagtcttcagaaagctgagaaagtgctgaagaaggtactggaatggaacaaggaagaggtacccaacaaggatgaactggttggaaacttgtatagctgcatagggaatgcccagattgagctggggcagatggaggcagccctgcagagccacagaaaggacctggagatcgccaaggaatatgaccttcctgatgcaaaatcgagagcccttgacaacattggcagagtttttgccagagttgggaaattccagcaagccattgacacgtgggaagaaaagatccctctggcaaaaaccaccctggagaagacctggctgttccacgagatcggccgctgctacttggagctggaccaggcctggcaggcccagaattatggcgagaagtcccagcagtgtgccgaggaggaaggggacattgagtggcaactgaatgccagtgttctggtggcccaggcacaagtgaagctgagagacttcgagtcagccgtgaacaattttgagaaggccctggagagagcaaagcttgtgcataacaacgaggcgcagcaggccatcatcagtgccttggacgatgccaacaagggtatcatcagagaactgaggaaaaccaactacgtggagaatctcaaagaaaaaagcgagggagaagcttcactgtatgaagatagaataataacaagagagaaggacatgaggagagtgagagatgagcccgagaaggtggtgaagcagtgggaccatagtgaggatgagaaagagacagatgaggacgatgaggcttttggggaagctctgcagagcccagcaagcggaaagcagagtgtggaagcaggaaaagccagaagcgatttgggagcagttgccaagggcctgtcaggagaattaggcacaagatcaggagaaacaggcaggaagctactagaagctggcagaagagagtcaagagaaatttataggaggccttcgggagaattagagcaaagactctcaggagaattcagcagacaggaaccagaagaactaaagaaactttcagaagtgggcagaagagagccagaagaactgggaaaaacacaatttggagaaataggagaaacgaaaaacaggaaatgagatggaaaaggaatatgaatgaagccatcggtagagatgaggatcaggaagctggtgttcagagggatcatgggattttattaaactggattttcaagcgatttgtctgttataggaaaaatgagggttttacttctgctgctttccatcactattttgccattaaataggtgtctttcactcttgc

SEQ ID NO: 190524 - DNA, 770 bp, Homo sapiens
  Payload ID: 17635
  Gene Name: tetratricopeptide repeat domain 25
  ENST ID: ENST00000593239
  CDS Start-End: 90-347
gctaagaaacggagcttccacaaaccagatagaggttctccagcttttctttgattgtctctgctttagcgtctctaaatccggtcaccatgtcggaccccgaaggcgagaccttgcgaagcacctttccctcttatatggccgaaggcgagcggctctacctgtgcggggaattttctaaagccgcgcagagcttcagcaacgctctttaccttcaggatggagacaagaactgcctggttgctcgctcaaagtgcttcctgaagatgggagacttggagagatccctgaaggatgctgaggcttcgctccagagtgacccagctttctgtaaggtcattgcctaagtccctgccccctgtattccaaccttgaccttcaacccaggacccttctgttccaccacatgtccttcttccattaagctggagaacaaaggggacctctccttcttaagcaagcaggctgagaatataaaagcccagcagaagcctcagcccatgaaacacctcttacaccccaccaagggagagcccaagtggaaggcctcgctcaagagtgagaagactgtccgccagcttctgggggagctctacgtggacaaagagtatttggagaagctcctattggatgaagacctgatcaaaggcaccatgaagggcggcctgactgtggaggacctcatcatgacgggcatcaactacctggatactcacagcaacttctggaggcagcagaagccgatctacgccagggagcgggaccggaag

SEQ ID NO: 190525 - DNA, 2015 bp, Homo sapiens
  Payload ID: 17636
  Gene Name: tetratricopeptide repeat domain 26
  Uniprot ID: A0AVF1
  ENST ID: ENST00000343187
  CDS Start-End: 76-1647
gtgctgtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggaggaatacgaaaatgctacaaaagaggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaagtttaatgatgagaaaaaattgatgagctttcatcaaaatcttcaggatgtcacagaagatcaactcagtttggcctcaatccactatatgcgatctcactaccaagaagctatagatatatataagcgaatactgctagataacagggaataccttgcccttaatgtttatgtggccctctgctactacaagttggattactatgatgtgtctcaagaagttttggctgtttaccttcagcaaattcctgatagtaccatcgcactcaatcttaaagcctgtaaccattttcgcctttacaatggcagagcagctgaggcagaactcaaaagcttgatggacaatgcttcttcatcctttgaatttgctaaagaactcatcaggcacaatctggttgttttccgaggaggtgaaggggctttgcaggttttacctcccctagttgatgtcattcctgaagctaggctaaacttggtgatttactaccttcgtcaagatgatgtacaagaagcttataacttaattaaggatctggaacctactactcctcaggagtatattctcaaaggagtggtcaatgcagcccttggccaggaaatgggttcaagggatcatatgaaaattgcccagcagttcttccagttggtgggaggatcagctagtgaatgtgatacaataccagggaggcagtgcatggcttcctgtttcttcctgcttaagcaatttgatgatgttttgatttacctcaactcatttaagagttacttctataatgatgacatctttaactttaattatgcccaagccaaagctgcaacaggcaataccagtgagggcgaagaggcgttcctcttgatccaaagtgagaagatgaaaaatgattacatttacctcagctggttagctcggtgctatattatgaataagaaaccaagactagcctgggaactttatcttaagatggaaacctccggcgagtccttcagtctcttacagctcattgctaatgactgctacaagatgggccagttttactattctgccaaagcttttgatgtccttgagaggctggatcctaaccctgaatattgggaaggcaaacggggtgcctgtgtgggcattttccagatgatcatagctgggagagaacccaaagagacccttcgagaagtgctccatttactgagaagcacaggtaacacccaagtagaatacatgatccggatcatgaagaaatgggccaaagaaaacagagtgtccatctaaaatagcgccagcgtcctaggaaccagcttctactttgacataaaactggaaatcattttcactccagtttaatctgtgatacagggctctgttttattgacattttccttccttgctctttaagcctcaaggtcagagactgacttgctgagacttagtctcctggctgaacagagtgccatagtctgtgaccctgtatgatcctagtagcaataagattttggacttatctggtgcctttcttccaaaaatgctcagagtacttttatgcaatttactgactttaaggaaaacagtataacttttttttgttagcattttatggcattgtctcctggctgcaataacaaacatctttgatgttcaag

SEQ ID NO: 190526 - DNA, 4198 bp, Homo sapiens
  Payload ID: 17636
  Gene Name: tetratricopeptide repeat domain 26
  Uniprot ID: A0AVF1
  ENST ID: ENST00000430935
  CDS Start-End: 115-1578
cgtaccagcgtccaggcggggttaccgtggagacagaacgtgctgtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggagttcaaacgtcatgttggggaagaagaagaggatactaatttgtggattggatattgtgcctttcacctgggtgactacaagagagctctggaggaatacgaaaatgctacaaaagaggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaagtttaatgatgagaaaaaattgatgagctttcatcaaaatcttcaggatgtcacagaagatcaactcagtttggcctcaatccactatatgcgatctcactaccaagaagctatagatatatataagcgaatactgctagataacagggaataccttgcccttaatgtttatgtggccctctgctactacaagttggattactatgatgtgtctcaagaagttttggctgtttaccttcagcaaattcctgatagtaccatcgcactcaatcttaaagcctgtaaccattttcgcctttacaatggcagagcagctgaggcagaactcaaaagcttgatggacaatgcttcttcatcctttgaatttgctaaagaactcatcaggcacaatctggttgttttccgaggaggtgaaggggctttgcaggttttacctcccctagttgatgtcattcctgaagctaggctaaacttggtgatttactaccttcgtcaagatgatgtacaagaagcttataacttaattaaggatctggaacctactactcctcaggagtatattctcaaaggagtggtcaatgcagcccttggccaggaaatgggttcaagggatcatatgaaaattgcccagcagttcttccagttggtgggaggatcagctagtgaatgtgatacaataccagggaggcagtgcatggcttcctgtttcttcctgcttaagcaatttgatgatgttttgatttacctcaactcatttaagagttacttctataatgatgacatctttaactttaattatgcccaagccaaagctgcaacaggcaataccagtgagggcgaagaggcgttcctcttgatccaaagtgagaagatgaaaaatgattacatttacctcagctggttagctcggtgctatattatgaataagaaaccaagactagcctgggaactttatcttaagatggaaacctccggcgagtccttcagtctcttacagctcattgctaatgactgctacaagagagacccttcgagaagtgctccatttactgagaagcacaggtaacacccaagtagaatacatgatccggatcatgaagaaatgggccaaagaaaacagagtgtccatctaaaatagcgccagcgtcctaggaaccagcttctactttgacataaaactggaaatcattttcactccagtttaatctgtgatacagggctctgttttattgacattttccttccttgctctttaagcctcaaggtcagagactgacttgctgagacttagtctcctggctgaacagagtgccatagtctgtgaccctgtatgatcctagtagcaataagattttggacttatctggtgcctttcttccaaaaatgctcagagtacttttatgcaatttactgactttaaggaaaacagtataacttttttttgttagcattttatggcattgtctcctggctgcaataacaaacatctttgatgttcaagaatcagcatcattgtatcatttaactttaaggcgtctctgtacgttatcccattttattggggaattccataaagggttttataacgtcatctctgaatcttgggagaataactagctatgtgtttctaagaaaggcagtaagctactttatcaaactgtccagtcattaataggatagatttatgggattactctttcagtaattaaattgttgatgataataacatgttacagcgcagtaagatgagtattgcaatgttttaaaaggtgagtactatgaaaaaaattgtagtacctctaaaggtattcaagaaacaatgtttatgaatctcactagtccattatagtttggtaccataattattttaggtaacaaagcaggttaggtttttgttaatgtatcttgcttaacaaacatcagtttttgttgttgttgttgttgttgttgttgttgttgtttttgagacggagtctcgctctgtcgcccaggctggagtacagtggtgcgatctcggctcactgcaagctccacctcctgggttcacgccagtctcctgcctcagccttctgagtagctgggactacaggcacccgccaccgcgcccggctaattttttgtatttttagtagagacggggtttcaccgtgttagccacaatgctctccatctcctgacctcgtgatccgcccgtctcagcctcccaaagtgctgggattacaggcatgagccaccgcgcctggcccaaacatcagttttgaaagtagggctacagtgatttatatgtattgtgggcacttattaatgtaacgataataaaacatgaatcgtataaagtcctttgagggaatctcctaatggctaggctctctgtcgtaagtcatattccagccccaggcttctgagctcttataacatacaactgagcattcttaagctcacaacctatttccagaaaagagacccacatctttctatgttttatactacctttgtttttacaccatatagtttttttctattagtttaaggtacctagtgttacaggtctagaaagtgcagagccatccctacctagaagagaatagatgggaagagaactgaaagaaagaattcctcaagcactgaagtcaggaaaatccccgtaggcactgtattagttgttccatttatcccagcactccacttgtggatgaaggagttgtatagaaaggagatgagaaaatggcaggagtggaagcagccaagaagagatcgatgactgaagatctccttcaccttcaggactgtctcaaggggttatttcacctctactcatgaggatggccagtttttctgtcttttatctttagacccatatataatcagttcagagcacaaatcaaaataaactggcctaaataactgaattctaggaagcaaagctacatcttttttcatatgccaaagcttctgtttcctcatgttgttcctactttttaaataataaatggctctcagcatcttaggaactagatgggtcccatctgggtagaacctgctataatttttagaatcactcttgtaattcttacctcacttaaaatattaggaaacacagtaatagaaaagacagggagaactcgtctgcaggttttggcagtgaaatttgtcttccagtgaattgctattattttcaaattgcctatagtcaaaaagcttttccattgatggagacttactttcaaatgagcttgtgttgaattcagcactctagattctctctgacattttcctgtcttttgggaaaaaaaagcagatattccaaaaatggcagaaatctaatttttgtaaactttttcatctataggattgagccaaaaaacatacatactattttaaagaaaggtaccatctaattcttttattaaagatagctacttctgaaatgtcttaacagagtttcaagattgcaaagtagtattgcatagctggttttcttacatgtgatgatggaggagagaggaagacccagacttaggcatgtagtgaaatatgtacagtttctggcatcagtgtactatttatagtctatagcatacattacttgcaaatgggaaaagtattttataattatttttgtacctcaaaataattattatattctactgtattatattcaaattaaagtttattatttgattctt

SEQ ID NO: 190527 - DNA, 1599 bp, Homo sapiens
  Payload ID: 17636
  Gene Name: tetratricopeptide repeat domain 26
  ENST ID: ENST00000495038
  CDS Start-End: 95-1366
gttaccgtggagacagaacgtgctgtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggagttcaaacgtcatgttggggaagaagaagaggatactaatttgtggattggatattgtgcctttcacctgggtgactacaagagagctctggaggaatacgaaaatgctacaaaagaggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaaggttgttttccgaggaggtgaaggggctttgcaggttttacctcccctagttgatgtcattcctgaagctaggctaaacttggtgatttactaccttcgtcaagatgatgtacaagaagcttataacttaattaaggatctggaacctactactcctcaggagtatattctcaaaggagtggtcaatgcagcccttggccaggaaatgggttcaagggatcatatgaaaattgcccagcagttcttccagttggtgggaggatcagctagtgaatgtgatacaataccagggaggcagtgcatggcttcctgtttcttcctgcttaagcaatttgatgatgttttgatttacctcaactcatttaagagttacttctataatgatgacatctttaactttaattatgcccaagccaaagctgcaacaggcaataccagtgagggcgaagaggcgttcctcttgatccaaagtgagaagatgaaaaatgattacatttacctcagctggttagctcggtgctatattatgaataagaaaccaagactagcctgggaactttatcttaagatggaaacctccggcgagtccttcagtctcttacagctcattgctaatgactgctacaagatgggccagttttactattctgccaaagcttttgatgtccttgagaggctggatcctaaccctgaatattgggaaggcaaacggggtgcctgtgtgggcattttccagatgatcatagctgggagagaacccaaagagacccttcgagaagtgctccatttactgagaagcacaggtaacacccaagtagaatacatgatccggatcatgaagaaatgggccaaagaaaacagagtgtccatctaaaatagcgccagcgtcctaggaaccagcttctactttgacataaaactggaaatcattttcactccagtttaatctgtgatacagggctctgttttattgacattttccttccttgctctttaagcctcaaggtcagagactgacttgctgagacttagtctcctggctgaacagagtgccatagtctgtgaccctgtatgatcctagtagcaataagattttggacttatctg

SEQ ID NO: 190528 - DNA, 1794 bp, Homo sapiens
  Payload ID: 17636
  Gene Name: tetratricopeptide repeat domain 26
  ENST ID: ENST00000478836
  CDS Start-End: 81-1424
agaacgtgctgtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggagttcaaacgtcatgttggggaagaagaagaggatactaatttgtggattggatattgtgcctttcacctgggtgactacaagagagctctggaggaatacgaaaatgctacaaaagaggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaaggcagaactcaaaagcttgatggacaatgcttcttcatcctttgaatttgctaaagaactcatcaggcacaatctggttgttttccgaggaggtgaaggggctttgcaggttttacctcccctagttgatgtcattcctgaagctaggctaaacttggtgatttactaccttcgtcaagatgtacaagaagcttataacttaattaaggatctggaacctactactcctcaggagtatattctcaaaggagtggtcaatgcagcccttggccaggaaatgggttcaagggatcatatgaaaattgcccagcagttcttccagttggtgggaggatcagctagtgaatgtgatacaataccagggaggcagtgcatggcttcctgtttcttcctgcttaagcaatttgatgatgttttgatttacctcaactcatttaagagttacttctataatgatgacatctttaactttaattatgcccaagccaaagctgcaacaggcaataccagtgagggcgaagaggcgttcctcttgatccaaagtgagaagatgaaaaatgattacatttacctcagctggttagctcggtgctatattatgaataagaaaccaagactagcctgggaactttatcttaagatggaaacctccggcgagtccttcagtctcttacagctcattgctaatgactgctacaagatgggccagttttactattctgccaaagcttttgatgtccttgagaggctggatcctaaccctgaatattgggaaggcaaacggggtgcctgtgtgggcattttccagatgatcatagctgggagagaacccaaagagacccttcgagaagtgctccatttactgagaagcacaggtaacacccaagtagaatacatgatccggatcatgaagaaatgggccaaagaaaacagagtgtccatctaaaatagcgccagcgtcctaggaaccagcttctactttgacataaaactggaaatcattttcactccagtttaatctgtgatacagggctctgttttattgacattttccttccttgctctttaagcctcaaggtcagagactgacttgctgagacttagtctcctggctgaacagagtgccatagtctgtgaccctgtatgatcctagtagcaataagattttggacttatctggtgcctttcttccaaaaatgctcagagtacttttatgcaatttactgactttaaggaaaacagtataacttttttttgttagcattttatggcattgtctcctggctgcaataacaaacatctttgatgttcaagaa

SEQ ID NO: 190529 - DNA, 4299 bp, Homo sapiens
  Payload ID: 17636
  Gene Name: tetratricopeptide repeat domain 26
  Uniprot ID: A0AVF1
  ENST ID: ENST00000464848
  CDS Start-End: 81-1745
agaacgtgctgtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggagttcaaacgtcatgttggggaagaagaagaggatactaatttgtggattggatattgtgcctttcacctgggtgactacaagagagctctggaggaatacgaaaatgctacaaaagaggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaagtttaatgatgagaaaaaattgatgagctttcatcaaaatcttcaggatgtcacagaagatcaactcagtttggcctcaatccactatatgcgatctcactaccaagaagctatagatatatataagcgaatactgctagataacagggaataccttgcccttaatgtttatgtggccctctgctactacaagttggattactatgatgtgtctcaagaagttttggctgtttaccttcagcaaattcctgatagtaccatcgcactcaatcttaaagcctgtaaccattttcgcctttacaatggcagagcagctgaggcagaactcaaaagcttgatggacaatgcttcttcatcctttgaatttgctaaagaactcatcaggcacaatctggttgttttccgaggaggtgaaggggctttgcaggttttacctcccctagttgatgtcattcctgaagctaggctaaacttggtgatttactaccttcgtcaagatgatgtacaagaagcttataacttaattaaggatctggaacctactactcctcaggagtatattctcaaaggagtggtcaatgcagcccttggccaggaaatgggttcaagggatcatatgaaaattgcccagcagttcttccagttggtgggaggatcagctagtgaatgtgatacaataccagggaggcagtgcatggcttcctgtttcttcctgcttaagcaatttgatgatgttttgatttacctcaactcatttaagagttacttctataatgatgacatctttaactttaattatgcccaagccaaagctgcaacaggcaataccagtgagggcgaagaggcgttcctcttgatccaaagtgagaagatgaaaaatgattacatttacctcagctggttagctcggtgctatattatgaataagaaaccaagactagcctgggaactttatcttaagatggaaacctccggcgagtccttcagtctcttacagctcattgctaatgactgctacaagatgggccagttttactattctgccaaagcttttgatgtccttgagaggctggatcctaaccctgaatattgggaaggcaaacggggtgcctgtgtgggcattttccagatgatcatagctgggagagaacccaaagagacccttcgagaagtgctccatttactgagaagcacaggtaacacccaagtagaatacatgatccggatcatgaagaaatgggccaaagaaaacagagtgtccatctaaaatagcgccagcgtcctaggaaccagcttctactttgacataaaactggaaatcattttcactccagtttaatctgtgatacagggctctgttttattgacattttccttccttgctctttaagcctcaaggtcagagactgacttgctgagacttagtctcctggctgaacagagtgccatagtctgtgaccctgtatgatcctagtagcaataagattttggacttatctggtgcctttcttccaaaaatgctcagagtacttttatgcaatttactgactttaaggaaaacagtataacttttttttgttagcattttatggcattgtctcctggctgcaataacaaacatctttgatgttcaagaatcagcatcattgtatcatttaactttaaggcgtctctgtacgttatcccattttattggggaattccataaagggttttataacgtcatctctgaatcttgggagaataactagctatgtgtttctaagaaaggcagtaagctactttatcaaactgtccagtcattaataggatagatttatgggattactctttcagtaattaaattgttgatgataataacatgttacagcgcagtaagatgagtattgcaatgttttaaaaggtgagtactatgaaaaaaattgtagtacctctaaaggtattcaagaaacaatgtttatgaatctcactagtccattatagtttggtaccataattattttaggtaacaaagcaggttaggtttttgttaatgtatcttgcttaacaaacatcagtttttgttgttgttgttgttgttgttgttgttgttgtttttgagacggagtctcgctctgtcgcccaggctggagtacagtggtgcgatctcggctcactgcaagctccacctcctgggttcacgccagtctcctgcctcagccttctgagtagctgggactacaggcacccgccaccgcgcccggctaattttttgtatttttagtagagacggggtttcaccgtgttagccacaatgctctccatctcctgacctcgtgatccgcccgtctcagcctcccaaagtgctgggattacaggcatgagccaccgcgcctggcccaaacatcagttttgaaagtagggctacagtgatttatatgtattgtgggcacttattaatgtaacgataataaaacatgaatcgtataaagtcctttgagggaatctcctaatggctaggctctctgtcgtaagtcatattccagccccaggcttctgagctcttataacatacaactgagcattcttaagctcacaacctatttccagaaaagagacccacatctttctatgttttatactacctttgtttttacaccatatagtttttttctattagtttaaggtacctagtgttacaggtctagaaagtgcagagccatccctacctagaagagaatagatgggaagagaactgaaagaaagaattcctcaagcactgaagtcaggaaaatccccgtaggcactgtattagttgttccatttatcccagcactccacttgtggatgaaggagttgtatagaaaggagatgagaaaatggcaggagtggaagcagccaagaagagatcgatgactgaagatctccttcaccttcaggactgtctcaaggggttatttcacctctactcatgaggatggccagtttttctgtcttttatctttagacccatatataatcagttcagagcacaaatcaaaataaactggcctaaataactgaattctaggaagcaaagctacatcttttttcatatgccaaagcttctgtttcctcatgttgttcctactttttaaataataaatggctctcagcatcttaggaactagatgggtcccatctgggtagaacctgctataatttttagaatcactcttgtaattcttacctcacttaaaatattaggaaacacagtaatagaaaagacagggagaactcgtctgcaggttttggcagtgaaatttgtcttccagtgaattgctattattttcaaattgcctatagtcaaaaagcttttccattgatggagacttactttcaaatgagcttgtgttgaattcagcactctagattctctctgacattttcctgtcttttgggaaaaaaaagcagatattccaaaaatggcagaaatctaatttttgtaaactttttcatctataggattgagccaaaaaacatacatactattttaaagaaaggtaccatctaattcttttattaaagatagctacttctgaaatgtcttaacagagtttcaagattgcaaagtagtattgcatagctggttttcttacatgtgatgatggaggagagaggaagacccagacttaggcatgtagtgaaatatgtacagtttctggcatcagtgtactatttatagtctatagcatacattacttgcaaatgggaaaagtattttataattatttttgtacctcaaaataattattatattctactgtattatattcaaattaaagtttattatttgattctta
